(12) United States Patent
DiMarchi et al.

(10) Patent No.: US 8,778,872 B2
(45) Date of Patent: Jul. 15, 2014

(54) AMIDE BASED GLUCAGON SUPERFAMILY PEPTIDE PRODRUGS

(75) Inventors: Richard D. DiMarchi, Carmel, IN (US); Binbin Kou, Bloomington, IN (US)

(73) Assignee: Indiana University Research and Technology Corporation, Indianapolis, IN (US)

( * ) Notice: Subject to any disclaimer, the term of this patent is extended or adjusted under 35 U.S.C. 154(b) by 0 days.

(21) Appl. No.: 13/697,021

(22) PCT Filed: Jun. 14, 2011

(86) PCT No.: PCT/US2011/040330
§ 371 (c)(1),
(2), (4) Date: Jan. 28, 2013

(87) PCT Pub. No.: WO2011/163012
PCT Pub. Date: Dec. 29, 2011

(65) Prior Publication Data
US 2013/0123462 A1 May 16, 2013

Related U.S. Application Data

(60) Provisional application No. 61/358,188, filed on Jun. 24, 2010.

(51) Int. Cl.
| | |
|---|---|
| A61K 38/26 | (2006.01) |
| A61P 3/10 | (2006.01) |
| A61P 3/00 | (2006.01) |
| A61P 3/08 | (2006.01) |

(52) U.S. Cl.
USPC ................ 514/1.3; 514/1.1; 514/5.3; 514/7.2

(58) Field of Classification Search
CPC ....... A61K 38/26; A61K 38/22; A61K 38/16; A61K 38/00; C07K 14/605; C07K 14/575; C07K 14/001; C07K 14/00; C07K 1/00
See application file for complete search history.

(56) References Cited

U.S. PATENT DOCUMENTS

| | | | |
|---|---|---|---|
| 3,740,385 | A | 6/1973 | Ondetti |
| 4,275,152 | A | 6/1981 | Esders et al. |
| 4,741,897 | A | 5/1988 | Andrews et al. |
| 5,359,030 | A | 10/1994 | Ekwuribe |
| 5,510,459 | A | 4/1996 | Smith et al. |
| 5,512,549 | A | 4/1996 | Chen et al. |
| 5,665,705 | A | 9/1997 | Merrifield et al. |
| 5,783,674 | A | 7/1998 | Geysin et al. |
| 6,180,767 | B1 | 1/2001 | Wickstrom et al. |
| 6,191,102 | B1 | 2/2001 | DiMarchi et al. |
| 6,583,111 | B1 | 6/2003 | DiMarchi et al. |
| 6,677,136 | B2 | 1/2004 | Marshall et al. |
| 7,045,337 | B2 | 5/2006 | Schultz et al. |
| 171,920 | A1 | 8/2006 | Shechter et al. |
| 7,192,922 | B2 | 3/2007 | Shannon et al. |
| 7,211,557 | B2 | 5/2007 | DiMarchi et al. |
| 7,326,688 | B2 | 2/2008 | O'Harte |
| 7,521,422 | B2 | 4/2009 | Bernard |
| 7,576,059 | B2 | 8/2009 | Jonassen et al. |
| 2002/0038026 | A1 | 3/2002 | Rao et al. |
| 2002/0049164 | A1 | 4/2002 | Demuth et al. |
| 2003/0021795 | A1 | 1/2003 | Houston et al. |
| 2003/0143183 | A1 | 7/2003 | Knudsen et al. |
| 2003/0204063 | A1 | 10/2003 | Gravel et al. |
| 2004/0002468 | A1 | 1/2004 | Wadsworth et al. |
| 2004/0054130 | A1 | 3/2004 | Ng et al. |
| 2004/0121940 | A1 | 6/2004 | DeGroot et al. |
| 2004/0235710 | A1 | 11/2004 | DeFelippis et al. |
| 2005/0014679 | A1 | 1/2005 | Beals et al. |
| 2005/0070469 | A1 | 3/2005 | Bloom et al. |
| 2005/0095679 | A1 | 5/2005 | Prescott et al. |
| 2005/0124550 | A1 | 6/2005 | Peri |
| 2005/0153890 | A1 | 7/2005 | Pan et al. |
| 2005/0187147 | A1 | 8/2005 | Newman et al. |
| 2005/0288248 | A1 | 12/2005 | Pan et al. |
| 2006/0003417 | A1 | 1/2006 | Pan et al. |
| 2006/0003935 | A1 | 1/2006 | Pan et al. |
| 2006/0171920 | A1 | 8/2006 | Shechter et al. |
| 2006/0210534 | A1 | 9/2006 | Lee et al. |
| 2006/0252916 | A1 | 11/2006 | DiMarchi et al. |
| 2006/0286129 | A1 | 12/2006 | Sarubbi |
| 2007/0042956 | A1 | 2/2007 | Johansen et al. |

(Continued)

FOREIGN PATENT DOCUMENTS

| | | |
|---|---|---|
| CA | 2024855 | 3/1992 |
| EP | 0220958 | 5/1987 |

(Continued)

OTHER PUBLICATIONS

De (Design of Peptide-Based Prodrug Chemistry and its Application to Glucagon-like Peptide I (Aug. 2007) Indiana University thesis. Retrieved from: https://scholarworks.iu.edu/dspace/bitstream/handle/2022/3185/Arnab_De_Final_Thesis_Signed.pdf?sequence=1.*
"Novel Glucagon-Based Peptides—Virtues of Combinatorial Pharmacology," AAPS 2005, San Francisco, California.
Ahn, J.M. et al., Development of potent truncated glucagon antagonists, J. Med. Chem., 44(9): 1372-9, Apr. 26, 2001. (Abstract).
Ahn, J.M. et al., A new approach to search for the bioactive conformation of glucagon: positional cyclization scanning, J. Med. Chem., 44(19): 3109-16, Sep. 13, 2001.
Althage et al.,JBC "Targeted Ablation of GIP-Producing Cells in Transgenic mice reduces obesity and insulin resistance induced by a high fat diet" 2008).
Andrews et al., "Forming Stable Helical Peptides Using Natural and Artificial Amino Acids", Tetrahedron 55: 11711-11743, (1999).
"Application of Chemical Biotechnology to Optimization of Endocrine Hormones," Carothers Lecture, Mar. 22, 2007.
Azizeh et al., "Pure glucagon antagonists: biological activities and cAMP accumulation using phosphodiesterase inhibitors," Peptides 1997, vol. 18, No. 5, pp. 633-641.

(Continued)

Primary Examiner — Karlheinz R Skowronek
Assistant Examiner — Catherine Mader
(74) Attorney, Agent, or Firm — Barnes & Thornburg LLP

(57) ABSTRACT

Prodrug formulations of glucagon superfamily peptides are provided wherein the glucagon superfamily peptide has been modified by the linkage of a dipeptide to the glucagon superfamily through an amide bond linkage. The prodrugs disclosed herein have extended half lives and are converted to the active form at physiological conditions through a non-enzymatic reaction driven by chemical instability.

25 Claims, 27 Drawing Sheets

(56) References Cited

U.S. PATENT DOCUMENTS

| | | |
|---|---|---|
| 2007/0173452 A1 | 7/2007 | DiMarchi et al. |
| 2007/0203058 A1 | 8/2007 | Lau et al. |
| 2007/0287670 A1 | 12/2007 | Natarajan et al. |
| 2008/0113411 A1 | 5/2008 | Sheffer et al. |
| 2008/0113905 A1 | 5/2008 | DiMarchi et al. |
| 2008/0125574 A1 | 5/2008 | Sheffer et al. |
| 2008/0318837 A1 | 12/2008 | Quay et al. |
| 2009/0036364 A1 | 2/2009 | Levy et al. |
| 2009/0054305 A1 | 2/2009 | Schlein et al. |
| 2009/0062192 A1 | 3/2009 | Christensen et al. |
| 2009/0074769 A1 | 3/2009 | Glaesner et al. |
| 2009/0137456 A1 | 5/2009 | DiMarchi et al. |
| 2009/0186817 A1* | 7/2009 | Ghosh et al. .............. 514/12 |
| 2009/0192072 A1 | 7/2009 | Pillutla et al. |
| 2010/0190699 A1 | 7/2010 | DiMarchi et al. |
| 2010/0190701 A1 | 7/2010 | Day et al. |
| 2011/0065633 A1 | 3/2011 | DiMarchi et al. |
| 2011/0098217 A1 | 4/2011 | Dimarchi et al. |
| 2011/0166062 A1 | 7/2011 | DiMarchi et al. |
| 2011/0190200 A1 | 8/2011 | DiMarchi et al. |
| 2011/0257092 A1 | 10/2011 | DiMarchi et al. |
| 2011/0288003 A1 | 11/2011 | DiMarchi et al. |

FOREIGN PATENT DOCUMENTS

| | | |
|---|---|---|
| EP | 0479210 | 4/1992 |
| EP | 0815135 | 9/1996 |
| EP | 1695983 B1 | 8/2006 |
| EP | 2036539 A1 | 3/2009 |
| EP | 2036923 A1 | 3/2009 |
| EP | 2398483 | 8/2010 |
| EP | 2300035 | 1/2012 |
| WO | WO 91/11457 | 8/1991 |
| WO | WO96/29342 | 9/1996 |
| WO | WO9707814 | 3/1997 |
| WO | 97/29180 | 8/1997 |
| WO | 98/11126 | 3/1998 |
| WO | 98/19698 | 5/1998 |
| WO | WO 9824464 | 6/1998 |
| WO | WO 9946283 | 9/1999 |
| WO | WO/99/67278 | 12/1999 |
| WO | WO 0020592 | 4/2000 |
| WO | WO00/42026 | 7/2000 |
| WO | WO 0058360 | 10/2000 |
| WO | 01/83527 | 11/2001 |
| WO | WO 0181919 | 11/2001 |
| WO | 01/98331 | 12/2001 |
| WO | WO 0210195 | 2/2002 |
| WO | WO0213801 | 2/2002 |
| WO | 02/48183 | 6/2002 |
| WO | WO 02100390 | 12/2002 |
| WO | WO03/011892 | 2/2003 |
| WO | 03/020201 | 3/2003 |
| WO | WO03022304 | 3/2003 |
| WO | WO 03026635 | 4/2003 |
| WO | 03/035099 | 5/2003 |
| WO | WO03/058203 | 7/2003 |
| WO | WO 03082898 | 10/2003 |
| WO | 03/103572 | 12/2003 |
| WO | WO 03103697 | 12/2003 |
| WO | WO 03105760 | 12/2003 |
| WO | WO2004000354 | 12/2003 |
| WO | 2004/022004 | 3/2004 |
| WO | 2004/067548 | 8/2004 |
| WO | WO 2004078777 | 9/2004 |
| WO | 2004/093823 | 11/2004 |
| WO | 2004/105781 | 12/2004 |
| WO | 2004/105790 | 12/2004 |
| WO | WO 2004103390 | 12/2004 |
| WO | WO 2005082928 | 9/2005 |
| WO | WO 2006086769 | 8/2006 |
| WO | WO 2006121904 | 11/2006 |
| WO | WO2006124529 | 11/2006 |
| WO | WO2006134340 A2 | 12/2006 |
| WO | 2007/022123 | 2/2007 |
| WO | WO2007028632 | 3/2007 |
| WO | WO2007028633 | 3/2007 |
| WO | 2007/056362 | 5/2007 |
| WO | WO 2007/096332 | 8/2007 |
| WO | 2007/100535 | 9/2007 |
| WO | WO 2007109354 | 9/2007 |
| WO | WO 2008021560 | 2/2008 |
| WO | WO 2008022015 | 2/2008 |
| WO | WO2008023050 | 2/2008 |
| WO | WO 2008076933 | 6/2008 |
| WO | 2008/086086 | 7/2008 |
| WO | 2008/101017 | 8/2008 |
| WO | WO2009030738 A1 | 3/2009 |
| WO | WO2009030774 A1 | 3/2009 |
| WO | WO2009034117 A1 | 3/2009 |
| WO | WO2009034118 A1 | 3/2009 |
| WO | WO2009034119 A1 | 3/2009 |
| WO | WO2009035540 A2 | 3/2009 |
| WO | 2009/058662 | 5/2009 |
| WO | 2009/058734 | 5/2009 |
| WO | WO 2009/067636 | 5/2009 |
| WO | 2009/095479 | 8/2009 |
| WO | 2009/099763 | 8/2009 |
| WO | 2009/155257 | 12/2009 |
| WO | 2009/155258 | 12/2009 |
| WO | 2010/011439 | 1/2010 |
| WO | WO 2010/011313 | 1/2010 |
| WO | 2010/071807 | 6/2010 |
| WO | 2010/080605 | 7/2010 |
| WO | 2010/096052 | 8/2010 |
| WO | 2010/148089 | 12/2010 |
| WO | 2011/075393 | 6/2011 |
| WO | WO 2011087671 | 7/2011 |
| WO | WO 2011087672 | 7/2011 |
| WO | 2011/094337 | 8/2011 |
| WO | WO2011119657 | 9/2011 |
| WO | WO2011143208 | 11/2011 |
| WO | WO2011143209 | 11/2011 |
| WO | WO2011163012 | 12/2011 |
| WO | WO2011163473 | 12/2011 |

OTHER PUBLICATIONS

Azizeh et al., "The Role of Phylalanine at Position 6 in Glucagon's Mechanism of Biological Action: Multiple Replacement Analgues of Glucgon," J. Med. Chem., vol. 40, No. 16, 1997, pp. 2555-2562.

Azizeh et al., "Topographical amino acid substitution in position 10 of glucagon leads to antagonists/partial agonists with greater binding differences," J. Med. Chem., vol. 39, No. 13, Jun. 21, 1996, pp. 2449-2455.

Battersby et al., "Diketopiperazine Formation and N-Terminal Degradation in Recombinant Human Growth Hormone", *International Journal of Peptide & Protein Research* 44: 215-222, (1994).

Biotechnology—A Basis for Better Health & Economic Prosperity, Ohio State University presentation, Aug. 28, 2010.

"Biotechnology—A Basis for Better Health & Economic Prosperity," Indiana University television presentation, Nov. 2010.

Blache et al., "Development of an oxyntomodulin/glicentin C-terminal radioimmunoassay using a "thiol-maleoyl" coupling method for preparing the immunogen," Anal Biochem 1988 173(1):151-159 (1988), abstract only.

Chabenne et al., Optimization of the native glucagon sequence for medicinal purposes, J. Diabetes. Sci. Technol., 4(6): 1322-31, Nov. 1, 2010.

Chia et al., "Exogenous glucose-dependent insulinotropic polypeptide worsens post-prandial hyperglycemia in type 2 diabetes," Diabetes, 58: 1342-1349 (2009).

Collie et al., "Purification and sequence of rat oxyntomodulin," Proc. Natl. Acad. Sci. USA, vol. 91, pp. 9362-9366, Sep. 1994.

DatabaseEMBL, Jul. 16, 2007, Richard DiMarchi and David Smiley, "Human Glucagon Peptide SEQ ID No. 1," XP002631582, retrieved from EBI, Database Accession No. AGB07042, Abstract.

Jonathan Day et al., "A New Glucagon and GLP-1 Co-Agonist Eliminates Obesity in Rodents," Nature Chemical Biology, vol. 5, No. 10, Oct. 2009, pp. 749-757.

(56) References Cited

OTHER PUBLICATIONS

Day et al., Charge inversion at position 68 of the glucagon and glucagon-like peptide-1 receptors supports selectivity in hormone action. *J. Pept. Sci.*, 17(3): 218-25, Nov. 30, 2010.
Day, J.; Patterson, J.; Gelfanov, V. and DiMarchi, Richard Molecular-basis for Specificity in Biological Action at the Homologous Glucagon and GLP-1 Receptors, (2009) Proceedings of the 21st American Peptide Society 142-143.
De, Design of peptide-based prodrug chemistry and its application to glucagon-like peptide 1. Masters Thesis Aug. 2007. [Retrieved from the Internet on Jun. 16, 2009: <https://scholarworksiu.edu/dspace/browse?value=De%2C+ArnabBtype=author>]; p. 8, para 2; p. 16, para 3; p. 40, para 1; p. 66, para 2; p. 77, para 1-2; p. 79, para 1.
De, Arnab; DiMarchi, Richard D. Investigation of the feasibily of an amide-based prodrug under physiological conditions. International Journal of Peptide Research and Therapeutics (2008), 14(4), 393.
De, et al., "Investigation of the feasibily of an amide-based prodrug under physiological conditions," Int. J. Pept. Res. Ther., 14, pp. 255-262 (2008).
De, A. and DiMarchi, R. Synthesis & Analysis of Peptide Hormone-based prodrugs, (2009) Proceedings of the 21st American Peptide Society 160-161.
De, A. and DiMarchi, R. Synthesis & Characterization of Ester-Based Prodrugs of Glucagon-Like Peptide 1, Peptide Science (2010) 94(4) 448-456.
DiMarchi, "Peptides—Development of Prodrug Chemistry," RBF Symposium Feb. 1-4, 2011 India.
DiMarchi, Richard, "The Use of Bioproducts in the Treatments of Metabolic Diseases" presentation slides for the Keystone Symposia (Jan. 25, 2009, Banff, Alberta).
Drucker, "Glucagon Gene Expression in Vertebrate Brain," The Journal of Biological Chemistry, vol. 263, No. 27, pp. 13475-13478, 1988.
Drucker, "The biology of incretin hormones," Cell Metabolism 3:153-165 (2006).
"Emergence of Chemical Biotechnology," Eli Lilly and Co. presentation, Jun. 22, 2009.
"The Emergence of Chemical Biotechnology & Its Application to Optimization of Endocrine Hormones," UMBC presentation, Mar. 26, 2008.
Eriksson et al., "hPEPT1 Affinity and Translocation of Selected Gln-Sar and Glu-Sar Dipeptide Derivatives", *Molecular Pharmaceutics* vol. 2, No. 3: 242-249 (May 10, 2005).
Evans et al., "Effect of β-Endorphin C-Terminal Peptides on Glucose Uptake in Isolated Skeletal Muscles of the Mouse," Peptides, vol. 18, No. 1, pp. 165-167, (1997).
Extended EP Search Report completed by the EP Searching Authority on Apr. 6, 2011 in connection with EP Patent Application No. 08845852.6.
Marita P. Feldkaemper et al., "Localization and Regulation of Glucagon Receptors in the Chick Eye and Preproglucagon and Glucagon Receptor Expression in the Mouse Eye," Experimental Eye Research, Academic Press Ltd., London, vol. 79, No. 3, Sep. 1, 2004, pp. 321-329.
Finan, B.; Gelfanov, V. and DiMarchi, R. Assessment of a Tat-Derived Peptide as a Vector for Hormonal Transport, (2009) Proceedings of the 21st American Peptide Society 321-322.
Garcia-Aparicio et al., "Design and Discovery of a Novel Dipeptidyl-peptidase IV (CD26)-Based Prodrug Approach", *J. Med. Chem.* 49: 5339-5351 (2006).
Gelfanov, et al., Discover and Structural Optimization of High Affinity Co-Agonists at the Glucagon and GLP-1 Receptors, Understanding Biology Using Peptides, Springer, pp. 763-764, Jun. 23, 2005.
GenBank entry AAH05278. Jul. 15, 2006. [Retrieved from the Internet Jun. 18, 2009: ~http://www._ncbi._nim.n_ih.gov/protein/13528972>].
Goolcharran et al., "Comparison of the Rates of Deamidation, Diketopiperazine Formation, and Oxidation in Recombinant Human Vascular Endothelial Growth Factor and Model Peptides", *AAPS Pharmsci 2000* 2(1) article 5: 1-6 (Mar. 17, 2000).

Gysin et al., "Design and Synthesis of Glucagon Partial Agonists and Antagonists," Biochemistry, 25, (1986), pp. 8278-8284.
Habegger et al., The metabolic actions of glucagon revisited, *Nat. Rev. Endocrinol.*, 6(12): 689-97, Oct. 19, 2010.
Habi, "Special Issue: Program and Abstracts for the 19th American Peptide Symposium, 2005, Abstracts of Poster Section C," (pp. 574-603) Article first published online: Jun. 10, 2005 | DOI: 10.1002/bip.20325.
Hansen et al., "Incretin hormones and insulin sensitivity," Trends in Endocrinology and Metabolism, vol. 16, No. 4, May/Jun. 2005, pp. 135-136.
Harris, J. Milton, Final Word: PEGylation—A "Sunset" Technology? <http://licence.icopyright.net/user/viewFreeUse.act?fuid=OTU1NjY3OA%3D%3D>, BioPharm International, Jun. 1, 2004.
Heppner et al., Glucagon regulation of energy metabolism, *Physiol Behav.*, 100(5): 545-8, Apr. 8, 2010.
Hjorth et al., "glucagon and Glucagon-like Peptide 1: Selective Receptor Recognition via Distinct Peptide Epitopes," The Journal of Biological Chemistry, vol. 269, No. 48, pp. 30121-30124, Dec. 2, 1994.
Hruby et al., "The Design and Biological Activities of Glucagon Agonists and Antagonists, and Their Use in Examining the Mechanisms of Glucose Action," *Curr. Med. Chem.-Imm., Endoc. & Metab. Agents*, 2001, 1, pp. 199-215.
Supplemental European Search Report issued in connection with EP Application No. 09800752 issued on Jun. 20, 2011.
Irwin et al., "Early administration of the glucose-dependent insulinotropic polypeptide receptor antagonist (Pro$^3$) GIP prevents the development of diabetes and related metabolic abnormalities associated with genetically inherited obesity in ob/ob mice," Diabetologia 50:1532-1540 (2007).
Joshi et al., "The Estimation of Glutaminyl Deamidation and Aspartyl Cleavage Rates in Glucagon," *International Journal of Pharmaceutics*, 273 (2004), pp. 213-219.
Joshi et al., "The Degradation Pathways of Glucagon in Acidic Solutions," *International Journal of Pharmaceutics*, 203 (2000), pp. 115-125.
Joshi et al, "Studies on the Mechanism of Aspartic Acid Cleavage and Glutamine Deamidation in the Acidic Degradation of Glucagon," *Journal of Pharmaceutical Sciences*, vol. 94, No. 9, Sep. 2005, pp. 1912-1927.
Krstenansky et al., "Importance of the C-terminal α-helical structure for glucagon's biological activity," Int. J. Peptide Protein Res., 32, 1988, 468-475.
Kukuch, A.; Patterson, J.; DiMarchi, R. and Tolbert, T. Immunoglobulin Fc-based Peptide Fusion Proteins as a Basis for Optimizing In Vivo Pharmacology, (2009) Proceedings of the 21$^{st}$ American Peptide Society 177-178.
Kulkarni, "GIP: No Longer the Neglected Incretin Twin?," Science Translational Medicine 2(49): p. 47, Sep. 15, 2010.
Lebl, Michal, "Peptides: Breaking Away: The Proceedings of the Twenty-First American Peptide Symposium", *Prompt Scientific Publishing* (2009).
Lee et al., "Synthesis, Characterization, and Pharmacokinetic Studies of PEGylated Glucagon-like Peptide-1," *Bioconjugate Chem.*, 2005, vol. 16, No. 2, pp. 377-382.
"Legacy Products—'Back to the Future'," presentation to Eli Lilly and Co., Sep. 22, 2005.
Levy et al., Optimization of the C-terminal Sequence in Glucagon to Maximize Receptor Affinity, *Understanding Biology Using Peptides*, American Peptide Society, Apr. 2006.
Levy et al., Optimization of the C-terminal Sequence in Glucagon to Maximize Receptor Affinity, Poster Presentation, Jun. 19, 2005.
Li et al., Crystallization and preliminary X-ray analysis of anti-obesity peptide hormone oxyntomodulin, *Protein & Peptide Letters*, 15(2): 232-4 (2008).
Li et al., Design, synthesis and crystallization of a novel glucagon analog as a therapeutic agent, *Acta Crystallogr. Sect. F Struct. Biol. Cryst. Commun.*, 63(Pt 7):599-601, Jun. 15, 2007.
Li et al., Structural Basis for Enhanced Solublity of a C-Terminally Extended Glucagon Analog, *Biopolymers.*, 96(4): 480 (2011).

(56) References Cited

OTHER PUBLICATIONS

Ma, T.; Day, J.; Gelfanov, V. and DiMarchi, R. Discovery and Structural Optimization of High Affinity Co-Agonists at the Glucagon and GLP-1 Receptors, (2009) Proceedings of the 21$^{st}$ American Peptide Society 146-147.
Madsen et al., "Structure—Activity and Protraction Relationship of Long-Acting Glucagon-like Peptide-1 Derivatives: Importance of Fatty acid Length, Polarity, and Bulkiness," J. Med. Chem. 2007, 50, pp. 6126-6132.
McKee et al., Receptor Binding and Adenylate Cyclase Activities of Glucagon Analogues Modified in the N-Terminal Region, Biochemistry, 25: 1650-6 (1986).
"Molecular Miracles," Indiana University, Apr. 13, 2011.
Montrose-Rafizadeh et al., "High Potency Antagonists of the Pancreatic Glucagon-like Peptide-1 Receptor," Journal of Biological Chemistry, 272(34) 21201-21206 (1997).
Murphy, et al., "Potent Long-Acting Alkylated Analogs of Growth Hormone-Releasing Factor," Pept. Res., vol. 1. No. 1, pp. 36-41 (1988).
Nogueiras et al., Direct control of peripheral lipid deposition by CNS GLP-1 receptor signaling is mediated by the sympathetic nervous system and blunted in diet-induced obesity, J. Neurosci., 29(18): 5916-25, May 6, 2009.
"Novel Glucagon Peptides That Demonstrate the Virtues of Combinatorial Pharmacology," University of Toledo, Mar. 22, 2012.
"Novel Glucagon-Based Peptides—Virtues of Combinatorial Pharmacology," Aug. 31, 2011, Berlin.
"Novel Glucagon-Based Peptides—Virtues of Combinatorial Pharmacology," European Peptide Symposium, Sep. 5-9, 2010, Copenhagen, Denmark.
"Novel Glucagon-Based Peptides—Virtues of Combinatorial Pharmacology," University of Michigan, Oct. 13, 2010.
"Novel Glucagon-Based Peptides—Virtues of Combinatorial Pharmacology," Yale University, May 13, 2011.
"Novel Glucagon-Like Chimera Peptides—Virtues of Combinatorial Pharmacology," AAPS May 2010.
"Novel Glucagon-Like Chimera Peptides—Virtues of Combinatorial Pharmacology," Keystone Conference, Apr. 12-17, 2010, Whistler, B.C.
"Novel Glucagon-Like Chimera Peptides—Virtues of Combinatorial Pharmacology," University of Cincinnati, Jun. 2010.
O'Brien, Assay for DPPIV Activity using Homogenous, Luminescent Method, Cell Notes 2005, 11:8-11.
Ouyang et al., Discovery of Bi-Functional Peptides Balanced in Glucagon Antagonism & GLP-1 Agonism. A Search for the Molecular Basis in the Inversion of Activity at Homologous Receptors, 71st Scientific sessions of American Diabetes Association 2011—Post-Conference Review and Analysis.
Ouyang et al., "Synthesis and Characterization of Peptides with Glucagon Antagonism and GLP -1 Agonism," poster presentation at the 21$^{st}$ American Peptide Symposium (Jun. 7-12, 2009, Bloomington, IN).
Pan et al., Design of a Long Acting Peptide Functioning as Both a Glucagon-like Peptide-1 Receptor Agonist and a Glucagon Receptor Agonist, *J. Biol. Chem.*, 281(18): 12506-15, Table 1, May 5, 2006.
Pan et al., "Synthesis of Cetuximab-Immunoliposomes via a Cholesterol-Based Membrane Anchor for Targeting of EGFR," Bioconjugate Chem., 18, pp. 101-108, 2007.
Patterson et al., A novel human-based receptor antagonist of sustained action reveals body weight control by endogenous GLP-1, *ACS Chem Biol.*, 6(2): 135-45 Nov. 4, 2010.
Patterson et al., Functional association of the N-terminal residues with the central region in glucagon-related peptides, *J. Peptide Sci.*, First published online Jun. 10, 2011.
PCT International Search Report for PCT/US2008/050099 completed by the US Searching Authority on Sep. 1, 2008.
PCT International Search Report for PCT/US2008/053857 completed by the US Searching Authority on Sep. 16, 2008.
PCT International Search Report for PCT/US2011/041601 completed by the US Searching Authority on Nov. 10, 2011.
PCT International Search Report for PCT/US2008/081333 completed by the US Searching Authority on Mar. 12, 2009.
PCT International Search Report for PCT/US2006/043334 completed by the US Searching Authority on Apr. 23, 2009.
PCT International Search Report for PCT/US2008/080973 completed by the US Searching Authority on Jun. 6, 2009.
PCT International Search Report for PCT/US2009/031593 completed by the US Searching Authority on Jun. 18, 2009.
PCT International Search Report for PCT/US2009/034448 completed by the US Searching Authority on Jun. 4, 2010.
PCT International Search Report for PCT/US2009/047437 completed by the US Searching Authority on Nov. 3, 2009.
PCT International Search Report for PCT/US2009/047447 completed by the US Searching Authority on Mar. 19, 2010.
PCT International Search Report for PCT/US2009/068678 completed by the US Searching Authority on May 5, 2010.
PCT International Search Report for PCT/US2010/038825 completed by the US Searching Authority on Sep. 15, 2010.
PCT International Search Report for PCT/US2010/059724 completed by the US Searching Authority on Jun. 14, 2011.
"Novel Glucagon-Based Peptides—Virtues of Combinatorial Pharmacology," Peptides Therapeutics Symposium, Oct. 21-22, 2010, La Jolla, California.
"Peptides: Frontiers of Peptide Science," Proceedings of the Fifteenth American Peptide Symposium, Jun. 14-19, 1997, Nashville, Tennessee, USA; ed. James P. Tam and Praven T.P. Kaumaya.
Perret et al., "Mutational analysis of the glucagon receptor: similarities with the vasoactive intestinal peptide (VIP)/pituitary adenylate cyclase-activating peptide (PACAP)/secretin receptors for recognition of the ligand's third residue," J. Biochem., 362 (2002), pp. 389-394.
Phillips et al., "Supramolecular Protein Engineering: Design of Zinc-Stapled Insulin Hexamers as a Long Acting Depot," J. Biol. Chem., vol. 285, No. 16, Apr. 16, 2010, pp. 11755-11759.
Robberecht, P. et al., "Receptor Occupancy and Adenylate Cyclase Activation in Rat Liver and Heart Membranes by 10 Glucagon Analogs Modified in Position 2, 3, 4, 25, 27 and/or 29," Regulatory Peptides, 21 (1988), 117-128.
M.J. Roberts et al., "Chemistry for Peptide and Protein PEGylation," Advance Drug Delivery Reviews, Elsevier BV, Amsterdam, NL, vol. 54, No. 4, Jun. 17, 2002, pp. 459-476.
Santos et al., Cyclization-Activated Prodrugs. Synthesis, Reactivity and Toxicity of Dipeptide Esters of Paracetamol, *Bioorganic & Medicinal Chemistry Letters* 15: 1595-1598 (2005).
Sapse et al., The Role of Sale Bridge Formation in Glucagon: An Experimental and Theoretical Study of Glucagon Analogs and Peptide Fragments of Glucagon, *Molec. Med.*, 8(5): 251-62, May 1, 2002.
Sato, H., "Enzymatic procedure for site-specific pegylation of proteins," Advanced Drug Delivery Reviews 54, pp. 487-504 (2002).
Schafmeister et al., "An All-Hydrocarbon Cross-Linking System for Enhancing the Helicity and Metaboli Stability of Peptides", *J. Am. Chem. Soc.* 122: 5891-5892 (2000).
"Speaking From the Gut: From Gastrointestinal Hormones to Combinatorial Therapies," Presentation to American Diabetes Association, Jun. 25, 2011.
Stigsnaes et al., "Characterisation and Physical Stability of PEGylated Glucagon," *International Journal of Pharmaceutics*, 330 (2007), pp. 87-98.
Sturm et al., "Structure-Function Studies on Positions 17, 18, and 21 Replacement Analogues of Glucagon: The Importance of Charged Residues and Salt Bridges in Glucagon Biological Activity," J Med Chem 1998, 41, 2693-2700.
Sueiras-Diaz et al., "Structure-Activity Studies on the N-Terminal Region of Glucagon," J. Med. Chem., 27, pp. 310-315, 1984.
Supplemental European Search Report issued in connection with EP Application No. 09767567.2 issued on Jun. 17, 2011.
"The Pursuit of Transformational Medicines," Keystone presentation, Jan. 29-Feb. 3, 2012, Santa Fe, NM.
"The Pursuit of Transformational Medicines," presentation to American Peptide Symposium, Jun. 25-30, 2011, San Diego, CA.
"The Pursuit of Transformational Medicines," NP2D presentation, Dec. 4, 2011.

(56) References Cited

OTHER PUBLICATIONS

Traylor et al., Identification of the High Potency Glucagon Agonist with Enhanced Biophysical Stability and Aqueous Solubility, Poster Abstract PY 10, pp. 505-506, Jun. 10, 2005.
Trivedi, D. et al., Design and synthesis of conformationally constrained glucagon analogues, J. Med. Chem., 43(9): 1714-22, May 4, 2000 (Abstract).
Tschoep et al., A Novel Glucagon/GLP-1 Co-Agonist Eliminates Obesity in Rodents, Diabetes, 58 (Supp. 1): A83 (2009).
Tschoep, Matthias, "A Novel Glucagon/GLP-1 Co-Agonist Eliminates Obesity in Rodents" presentation slides for the 2009 American Diabetes Association meeting (Jun. 5-9, 2009, New Orleans, LA).
Tschoep et al., "A Novel Glucagon/GLP-1 Co-Agonist Eliminates Obesity in Rodents," American Diabetes Association Abstract No. 313-OR (2009).
Tschoep, Matthias, "Afferent Gut Hormones in the Control of Energy Balance and Metabolism" presentation slides for the 21st American Peptide Symposium (Jun. 7-12, 2009, Bloomington, IN).
Tschoep, "CNS Integration of Systems Metabolism: Target Opportunities for Diabetes Prevention and Therapy," RBF Symposium Feb. 1-4, 2011 India.
"Two for the Money" Gut Hormone Hybrids, Tschoep, ADA meeting, Jun. 25-29, 2010, Orlando, FL.
Unson et al., "Glucagon antagonists: Contribution to binding and activity of the amino-terminal sequence 1-5, position 12 and the putative alpha-helical segment 19-27," J. Biol. Chem. v264, pp. 789-794, Jan. 15, 1989, p. 792, para 1, Table 1.
Unson et al., Positively Charged Residues at Positions 12, 17, and 18 of Glucagon Ensure Maximum Biological Potency, J. Biol. Chem., 273(17): 10308-12 (1998).
Unson et al., "Role of Histidine-1 in Glucagon Action," Archives of Biochemistry and Biophysics, vol. 300, No. 2, pp. 747-750, Feb. 1, 1993.
Vijayalakshmi et al., "Comparison of Helix-Stabilizing Effects of $\alpha$, $\alpha$-dialkyl Glycines with Linear and Cycloalkyl Side Chains", Biopolymers 53: 84-98 (Jan. 21, 2000).
Walensky et al., "Activation of Apoptosis in Vivo by a Hydrocarbon-Stapled BH3 Helix", Science 205: 1466-1470 (Sep. 3, 2004).
Ward, B.; Finan, B.; Gelfanov, V. and DiMarchi, R. Exploring the N-terminal Hydrophobic Faces of Glucagon and Glucagon-like Peptide-1, (2009) Proceedings of the 21$^{st}$ American Peptide Society 153-154.
Ward, "Fatty Acid Acylation of Peptides: Developing strategies to enhance medicines for treating metabolic disorders," Jan. 14, 2009.
Ward et al., In vitro and in vivo evaluation of native glucagon and glucagon analog (MAR-D28) during aging: lack of cytotoxicity and preservation of hyperglycemic effect, J. Diabetes Sci. Technol., 4(6):1311-21, Nov. 1, 2010.
Wibowo, Synthesis, Purification, and Biological Activity of AIB Substituted Glucagon and GLP-1 Peptide Analogues (2005-2006) vol. 45, 707=738, accessed https://scholarworks.iu.edu/dspce/handle/2022/326 on Jul. 17, 2012.
Wynne et al., "Subcutaneous Oxyntomodulin Reduces Body Weight in Overweight and Obese Subjects," Diabetes, vol. 54, Aug. 2005, pp. 2390-2395.
Yang, B. and DiMarchi, R.D. (2005). A Novel Approach to Resin-based Cysteine Alkylation Peptides: Chemistry, Structure and Biology, Proceedings of the XIX American Peptide Symposium, (88-89).
Yang et al., "A Novel Approach to Resin-Based Cysteine Alkylation," American Peptide Society, 2005.
Yang et al., "A Novel Approach to Resin-Based Cysteine Alkylation," poster presentation to American Peptide Society, 2005.
Yang et al., Synthesis and Biological Assessment of Sulfonic Acid-Based Glucagon Antagonists, Understanding Biology Using Peptides, American Peptide Symposia, 9(Part 6): 305-6 (2006).
Yang et al., "Synthesis and Biological Assessment of Sulfonic Acid-Based Glucagon Antagonists," American Peptide Society, 2005.
Yang et al., "Synthesis and Biological Assessment of Sulfonic Acid-Based Glucagon Antagonists," poster presentation to American Peptide Society, 2005.
Zhang et al., Design and synthesis of novel GLP1 analogues with significantly prolonged time action, Biopolymers., 80(4): 555 (2005).
Cheng et al., "The Development of an Insulin-based Prodrug," APS poster presentation, 2011.
Du et al., "Biochemistry and Molecular Biology International," vol. 45, No. 2, Jun. 1, 1998, pp. 255-260 XP008147747.
European supplemental search report for EP 09837983.7 completed by the EPO on Mar. 15, 2012.
Hamel et al "Cyclosporin a prodrugs: Design, synthesis and biophysical properties", J. Peptide Research, vol. 63, No. 2 pp. 147-154 (Feb. 2004).
Han et al., "IGF-based Insulin Analogs with an A-Chain Lactam," APS poster presentation, 2011.
Han et al., "Insulin Chemical Synthesis Using a Two-Step Orthogonal Formation of the Disulfides," APS poster presentation, Jun. 7, 2009.
Han et al., "Structure-Activity Relationship of Insulin at Position A$^{19}$," APS poster presentation, Jun. 7, 2009.
Kaur et al., "Chemical Synthesis of Insulin and Related Analogs," APS poster presentation, Jun. 7, 2009.
Kaur et al., "Novel Single Chain Insulin Analogs Consisting of a Non-Peptide Based Connection," APS poster presentation, May 12, 2011.
Kurapkat et al "Inactive conformation of an insulin despite its wild-type sequence", Protein Science, vol. 6, No. 3, pp. 580-587 (Mar. 1997).
Mroz, Piotr et al., "Bioactivity of Insulin Analogs with Altered B-Chain Secondary Structure," APS poster presentation, Jun. 7, 2009.
O'Brien, Assay for DPPIV Activity using a Homogenous, Luminescent Method, Cell Notes, 2005, 11:8-11 (http://www.promega.com/resources/articles/pubhub/cellnotes/assay-for-dppiv-activity-using-a-homogeneous-luminescent-method/).
PCT International Search Report for PCT/US2009/068711 completed by the US Searching Authority on Feb. 4, 2010.
Quan et al., "Coordinated Interaction of the Insulin B-chain Helical Domain with the aromatic Active Site," APS poster presentation, Jun. 7, 2009.
Zhao et al., "Improved Pharmacokinetics through Site-Specific PEGylation of Insulin Analogs," APS poster presentation, 2011.
Gershonov et al., "A Novel Approach for a Water-Soluble Long-Acting insulin Prodrug: Design, Preparation, and Analysis of [(2-Sulfo)-9-fluorenylmethoxycarbonyl]3-insulin," J. Med. Chem., 43, pp. 2530-2537 (2000).
Kristensen et al. Alanine Scanning Mutagenesis of Insulin. The Journal of Biological Chemistry 1997, 272(20):12978-12983; p. 12982, col. 1, first full para, p. 12982, col. 1, second full para.
Suaifan et al, "Effects of steric bulk and stereochemistry on the rates of diketopiperazine formation from N-aminoacyl-2,2-dimethylthiazolidine-4-carboxamides (Dmt dipeptide amides)—a model for a new prodrug linker system," Tetrahedron 62, pp. 11245-11266, (2006).

\* cited by examiner

Alignment of Amino Acid Sequences and Glucagon Superfamily Peptides

| | | |
|---|---|---|
| GHRH | YADAIFTNSYRKVLGQLSARKLLQDIMSR--------- | 29 |
| PHI | HADGVFTSDFSKLLGQLSAKKYLESLM----------- | 27 |
| VIP | HSDAVFTDNYTRLRKQMAVKKYLNSILN---------- | 28 |
| PACAP-38 | HSDGIFTDSYSRYRKQMAVKKYLAAVL----------- | 27 |
| Exendin-4 | HGEGTFTSDLSKQMEEEAVRLFIEWLKNGGPSSGAPPPS | 39 |
| GLP-1 | HAEGTFTSDVSSYLEGQAAKEFIAWLVKGRG------- | 31 |
| Glucagon | HSQGTFTSDYSKYLDSRRAQDFVQWLMNT--------- | 29 |
| Oxyntomodulin | HSQGTFTSDYSKYLDSRRAQDFVQWLMNTKRNRNNIA- | 37 |
| GIP | YAEGTFISDYSIAMDKIHQQDFVNWLLAQKGKKNDWKHNITQ | 42 |
| GLP-2 | HADGSFSDEMNTIIDNLAARDFINWLIQTKITD----- | 33 |
| Secretin | HSDGTFTSELSRLREGARLQRLLQGLV---------- | 27 |

AMIDE BASED GLUCAGON SUPERFAMILY PEPTIDE PRODRUGS

INCORPORATION BY REFERENCE OF MATERIAL SUBMITTED ELECTRONICALLY

Incorporated by reference in its entirety is a computer-readable nucleotide/amino acid sequence listing submitted concurrently herewith and identified as follows: One 957 KB ACII (Text) file named "Sequence_Listing 213134" created on Jun. 21, 2010.

CROSS REFERENCE TO RELATED APPLICATIONS

This application is a U.S. national counterpart application of international application serial No. PCT/US2011/040330 filed Jun. 14, 2011, which claims priority to U.S. Provisional Patent Application No. 61/358,188, filed on Jun. 24, 2010. The entire disclosures of PCT/US2011/040,330 and U.S. Ser. No. 61/358,188 are hereby incorporated by reference.

BACKGROUND

Peptide-based drugs are highly effective medicines with relatively short duration of action and variable therapeutic index. The present disclosure is directed to peptide-based prodrugs wherein the prodrug derivative is designed to delay onset of action and extend the half life of the drug. The delayed onset of action is advantageous in that it allows systemic distribution of the prodrug prior to its activation. Accordingly, the administration of prodrugs eliminates complications caused by peak activities upon administration and increases the therapeutic index of the parent drug.

Receptor recognition and subsequent processing of peptide and protein agonists is the primary route of degradation of many peptide and protein-based drugs. Thus binding of the peptide drug to its receptor will result in biological stimulation, but will also initiate the subsequent deactivation of the peptide/protein induced pharmacology through the enzymatic degradation of the peptide or protein. In accordance with the present disclosure, prodrugs can be prepared to extend the peptide or protein's biological half life based on a strategy of inhibiting recognition of the prodrug by the corresponding receptor.

The prodrugs disclosed herein will ultimately be chemically converted to structures that can be recognized by the receptor, wherein the speed of this chemical conversion will determine the time of onset and duration of in vivo biological action. The molecular design disclosed in this application relies upon an intramolecular chemical reaction that is not dependent upon additional chemical additives, or enzymes.

Pre-proglucagon is a 158 amino acid precursor polypeptide that is processed in different tissues to form a number of different proglucagon-derived peptides, including glucagon (SEQ ID NO: 701), glucagon-like peptide-1 (GLP-1; amino acids 7-36 are provided as SEQ ID NO: 703 and SEQ ID NO: 704), glucagon-like peptide-2 (GLP-2; SEQ ID NO: 708) and oxyntomodulin (OXM; SEQ ID NO: 706), that are involved in a wide variety of physiological functions, including glucose homeostasis, insulin secretion, gastric emptying, and intestinal growth, as well as the regulation of food intake.

Glucagon is a 29-amino acid peptide (that corresponds to amino acids 33 through 61 of pre-proglucagon, while GLP-1 is produced as a 37-amino acid peptide that corresponds to amino acids 72 through 108 of pre-proglucagon. GLP-1(7-36) amide (SEQ ID NO: 704; the C terminus is an arginine amide) or GLP-1-(7-37) acid (SEQ ID NO: 703; C terminus is a glycine) are biologically potent forms of GLP-1, that demonstrate essentially equivalent activity at the GLP-1 receptor.

Glucagon is a life-saving medicine that is used in the acute treatment of severe hypoglycemia. Oxyntomodulin has been reported to have pharmacological ability to suppress appetite and lower body weight. Clinical studies with GLP-1 receptor agonists or stabilized GLP-1 analogs have proven this family of peptides to be an effective treatment for Type II diabetes. In addition, it might be intrinsically safer than insulin therapy because of its glucose dependent action, thus eliminating the chances of hypoglycemia. Structure-activity relationship studies have shown that the N terminal histidine for each of these three peptides (glucagon, GLP-1 and oxyntomodulin) is especially important for the full action and that N-terminally extended forms severely diminish biological potency.

Additional peptides are known that resemble glucagon and GLP-1 in structure and have similar activities. For example, Exendin-4 is a peptide present in the saliva of the Gila monster that resembles GLP-1 in structure, and like glucagon and GLP-1, increases insulin release.

In addition, gastric inhibitory polypeptide (GIP) is also known as a glucose-dependent insulinotropic peptide, and is a member of the secretin family of hormones. GIP is derived from a 153-amino acid proprotein encoded by the GIP gene and circulates as a biologically active 42-amino acid peptide (SEQ ID NO: 707). The GIP gene is expressed in the small intestine as well as the salivary glands and is a weak inhibitor of gastric acid secretion. In addition to its inhibitory effects in the stomach, in the presence of glucose, GIP enhances insulin release by pancreatic beta islet cells when administered in physiological doses. GIP is believed to function as an enteric factor that stimulates the release of pancreatic insulin and that may play a physiological role in maintaining glucose homeostasis.

Osteocalcin (SEQ ID NO: 709) is a noncollagenous protein found in bone and dentin. It is secreted by osteoblasts and thought to play a role in mineralization and calcium ion homeostasis. Osteocalcin has also been reported to function as a hormone in the body, causing beta cells in the pancreas to release more insulin, and at the same time directing fat cells to release the hormone adiponectin, which increases sensitivity to insulin.

One disadvantage associated with the therapeutic use of bioactive peptides such as osteocalcin, GIP, glucagon, GLP-1 and oxyntomodulin is their extremely short half-life (approximately two minutes for glucagon and GLP-1) in plasma. Accordingly, to obtain reasonable glycemic control, native glucagon-related peptides would need to be administered continuously for a prolonged period of time. The short half life of glucagon and GLP-1 related peptides results from the rapid degradation by Dipeptidyl Peptidase IV (DPP-IV), which cleaves between the second and third amino acids. This cleavage not only inactivates the native peptides but in the case of glucagon and GLP-1 the shortened forms could be functional antagonists at their respective receptors. Accordingly, there is a need for longer-acting variants of GIP, glucagon, GLP-1, and oxyntomodulin, and related peptides, to realize the full therapeutic potential of these mechanisms of drug action

SUMMARY

In accordance with some embodiments a prodrug derivative of a bioactive polypeptide selected from the group consisting of glucagon, exendin-4, GLP-1, GLP-2, GIP, vasoactive intestinal peptide (VIP), Pituitary adenylate cyclase-activating polypeptide 27 (PACAP-27), peptide histidine methionine (PHM), oxyntomodulin, secretin, osteocalcin, growth hormone releasing hormone, as well as analogs, derivatives and conjugates of the foregoing is provided. The prodrug derivative comprises a dipeptide prodrug element covalently linked to an active site of the bioactive polypeptide via an amide linkage. In some embodiments the dipeptide is covalently bound to the bioactive polypeptide at a position that interferes with the bioactive polypeptide's ability to interact with its corresponding receptor or cofactor. In some embodiments the dipeptide prodrug element is linked to the amino-terminus of the bioactive peptide. Subsequent removal of the dipeptide, under physiological conditions and in the absence of enzymatic activity, restores full activity to the polypeptide.

In some embodiments a prodrug is provided having the general structure of A-B-Q. In this embodiment Q is a bioactive peptide, selected from the group of glucagon superfamily peptides, including glucagon-related peptides, osteocalcin, as well as analogs, derivatives and conjugates of the foregoing; and A-B represents a dipeptide prodrug linked to the bioactive peptide through an amide bond. More particularly, in some embodiments A is an amino acid or a hydroxy acid and B is an N-alkylated amino acid linked to Q through formation of an amide bond between a carboxyl of B (in A-B) and an amine of Q. Furthermore, in some embodiments, A, B, or the amino acid of Q to which A-B is linked, is a non-coded amino acid, and chemical cleavage of A-B from Q is at least about 90% complete within about 1 to about 720 hours in PBS under physiological conditions. In another embodiment, chemical cleavage of A-B from Q is at least about 50% complete within about 1 hour or about 1 week in PBS under physiological conditions.

In some embodiments A and B are selected to inhibit enzymatic cleavage of the A-B dipeptide from Q by enzymes found in mammalian serum. In some embodiments A and/or B are selected such that the cleavage half-life of A-B from Q in PBS under physiological conditions, is not more than two fold the cleavage half-life of A-B from Q in a solution comprising a DPP-IV protease (i.e., cleavage of A-B from Q does not occur at a rate more than 2× faster in the presence of DPP-IV protease and physiological conditions relative to identical conditions in the absence of the enzyme). In some embodiments A and/or B is an amino acid in the D stereoisomer configuration. In some exemplary embodiments, A is an amino acid in the D stereoisomer configuration and B is an amino acid in the L stereoisomer configuration. In some exemplary embodiments, A is an amino acid in the L stereoisomer configuration and B is an amino acid in the D stereoisomer configuration. In some exemplary embodiments, A is an amino acid in the D stereoisomer configuration and B is an amino acid in the D stereoisomer configuration.

In some embodiments the dipeptide prodrug element (A-B) comprises a compound having the general structure of Formula I:

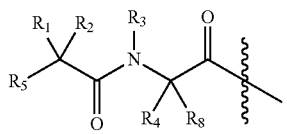

I wherein $R_1$, $R_2$, $R_4$ and $R_8$ are independently selected from the group consisting of H, $C_1$-$C_{18}$ alkyl, $C_2$-$C_{18}$ alkenyl, ($C_1$-$C_{18}$ alkyl)OH, ($C_1$-$C_{18}$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2^+$)NH$_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl)R$_7$, ($C_1$-$C_4$ alkyl)($C_3$-$C_9$ heteroaryl), and $C_1$-$C_{12}$ alkyl (W$_1$)$C_1$-$C_{12}$ alkyl, wherein W$_1$ is a heteroatom selected from the group consisting of N, S and O, or $R_1$ and $R_2$ together with the atoms to which they are attached form a $C_3$-$C_{12}$ cycloalkyl or aryl; or $R_4$ and $R_8$ together with the atoms to which they are attached form a $C_3$-$C_6$ cycloalkyl;

$R_3$ is selected from the group consisting of $C_1$-$C_{18}$ alkyl, ($C_1$-$C_{18}$ alkyl)OH, ($C_1$-$C_{18}$ alkyl)NH$_2$, ($C_1$-$C_{18}$ alkyl)SH, ($C_0$-$C_4$ alkyl)($C_3$-$C_6$)cyclo alkyl, ($C_0$-$C_4$ alkyl)($C_2$-$C_5$ heterocyclic), ($C_0$-$C_4$ alkyl)($C_6$-$C_{10}$ aryl)R$_7$, and ($C_1$-$C_4$ alkyl)($C_3$-$C_9$ heteroaryl) or $R_4$ and $R_3$ together with the atoms to which they are attached form a 4, 5 or 6 member heterocyclic ring;

$R_5$ is NHR$_6$ or OH;

$R_6$ is H, $C_1$-$C_8$ alkyl or $R_6$ and $R_2$ together with the atoms to which they are attached form a 4, 5 or 6 member heterocyclic ring; and $R_7$ is selected from the group consisting of H and OH.

It is apparent to one skilled in the art that when W$_1$ is N, under physiological conditions the nitrogen atom is linked to H.

In another embodiment the dipeptide prodrug element (A-B) comprises a compound having the general structure of Formula I:

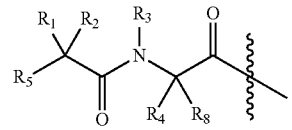

wherein $R_1$, $R_2$, $R_4$ and $R_8$ are independently selected from the group consisting of H, $C_1$-$C_{18}$ alkyl, $C_2$-$C_{18}$ alkenyl, ($C_1$-$C_{18}$ alkyl)OH, ($C_1$-$C_{18}$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2^+$)NH$_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl) R$_7$, ($C_1$-$C_4$ alkyl)($C_3$-$C_9$ heteroaryl), and $C_1$-$C_{12}$ alkyl (W$_1$)$C_1$-$C_{12}$ alkyl, wherein W$_1$ is a heteroatom selected from the group consisting of N, S and O, or $R_1$ and $R_2$ together with the atoms to which they are attached form a $C_3$-$C_{12}$ cycloalkyl; or $R_4$ and $R_8$ together with the atoms to which they are attached form a $C_3$-$C_6$ cycloalkyl;

$R_3$ is selected from the group consisting of $C_1$-$C_{18}$ alkyl, ($C_1$-$C_{18}$ alkyl)OH, ($C_1$-$C_{18}$ alkyl)NH$_2$, ($C_1$-$C_{18}$ alkyl)SH, ($C_0$-$C_4$ alkyl)($C_3$-$C_6$)cyclo alkyl, ($C_0$-$C_4$ alkyl)($C_2$-$C_5$ heterocyclic), ($C_0$-$C_4$ alkyl)($C_6$-$C_{10}$ aryl)R$_7$, and ($C_1$-$C_4$ alkyl)($C_3$-$C_9$ heteroaryl) or $R_4$ and $R_3$ together with the atoms to which they are attached form a 4, 5 or 6 member heterocyclic ring;

$R_5$ is NHR$_6$ or OH;

$R_6$ is H, $C_1$-$C_8$ alkyl or $R_6$ and $R_1$ together with the atoms to which they are attached form a 4, 5 or 6 member heterocyclic ring; and $R_7$ is selected from the group consisting of hydrogen, $C_1$-$C_{18}$ alkyl, $C_2$-$C_{18}$ alkenyl, ($C_0$-$C_4$ alkyl)CONH$_2$, ($C_0$-$C_4$ alkyl)COOH, ($C_0$-$C_4$ alkyl)NH$_2$, ($C_0$-$C_4$ alkyl)OH, and halo.

As described above, in some aspects there is provided a prodrug having the general structure of A-B-Q, wherein Q is a glucagon superfamily peptide (e.g. a glucagon related peptide, Growth Hormone Releasing Hormone (GHRH; SEQ ID NO: 719), vasoactive intestinal peptide (VIP; SEQ ID NO: 720), Pituitary adenylate cyclase-activating polypeptide 27 (PACAP-27; SEQ ID NO: 721), peptide histidine methionine (PHM; SEQ ID NO: 722), or Secretin (SEQ ID NO: 723), and/or and analogs, derivatives and conjugates thereof). Glucagon superfamily peptides may have common structural characteristics, including but not limited to homology within the N-terminal amino acids and/or alpha-helical structure within the C-terminal portion. It is believed that the C-terminus generally functions in receptor binding and the N-terminus generally functions in receptor signaling. A few amino acids in the N-terminal portion and C-terminal portion are highly conserved among members of the glucagon superfamily, for example, His1, Gly4, Phe6, Phe22, Val23, Trp25, and Leu26, with amino acids at these positions showing identity, conservative substitutions or similarity in amino acid side chains. In some embodiments Q is a glucagon related peptide, e.g. glucagon (SEQ ID NO: 701), oxyntomodulin (SEQ ID NO: 706), exendin-4 (SEQ ID NO: 718), Glucagon-like peptide-1 (GLP-1) (amino acids 7-37 provided as SEQ ID NOs: 703 and 707), Glucagon-like peptide-2 (GLP-2) (SEQ ID NO: 708), GIP (SEQ ID NO: 707) or analogs, derivatives and conjugates of the foregoing. In some embodiments Q as a glucagon related peptide comprises an amino acid sequence that is at least about 40%, 45%, 50%, 55%, 60%, 65%, 70%, 75%, 80%, 85%, 90%, or 95% identical to the corresponding sequence of native glucagon, native oxyntomodulin, native exendin-4, native (7-37)GLP-1, native GLP-2, or native GIP over the length of the native peptide (or over the positions which correspond to glucagon, see e.g., FIG. 10). In other embodiments, a glucagon superfamily peptide (Q) comprises an amino acid sequence of native glucagon, native exendin-4, native (7-37)GLP-1, native GLP-2, native GHRH, native VIP, native PACAP-27, native PHM, native Oxyntomodulin, native Secretin, or native GIP with up to 1, 2, 3, 4, 5, 6, 7, 8, 9 or 10 amino acid modifications. In still further embodiments, Q comprises an amino acid sequence which is a chimera of two or more native glucagon related peptide sequences. In some embodiments, Q comprises an amino acid sequence at least about 50% identical to native glucagon (SEQ ID NO: 701) that retains the alpha-helix conformation of the amino acids corresponding to amino acids 12-29 of SEQ ID NO: 701.

Q may be any of the glucagon superfamily peptides that are known in the art, including for example, any glucagon related peptides as known in the art, some of which are disclosed herein by way of nonlimiting examples. A variety of GLP-1 analogs are known in the art and are a glucagon-related peptide according to the current invention, see, e.g., WO 2008023050, WO 2007030519, WO 2005058954, WO 2003011892, WO 2007046834, WO 2006134340, WO 2006124529, WO 2004022004, WO 2003018516, WO 2007124461 each incorporated herein by reference in its entirety for each of its sequence or formula disclosures of GLP-1 analogs or derivatives. In certain embodiments, Q is a Class 1, 2, 3, 4 or 5 glucagon related peptide as detailed herein. In any of the embodiments described herein, Q is any of SEQ ID NOs: 1-684, 701-742, 801-919, 1001-1262, 1301-1371, 1401-1518, 1701-1776, and 1801-1908.

While the dipeptide prodrug, e.g. A-B, may be linked to Q at any position that interferes with the activity of Q, embodiments disclosed herein illustrate examples of positions that are suitable for linkage of A-B. When position numbers are named herein by referring to the position in the native glucagon sequence (SEQ ID NO: 701), the corresponding position in glucagon analogs or in other glucagon superfamily peptides can be determined by alignment. See, e.g., FIG. 10 which shows an alignment of certain glucagon superfamily peptides. For example, position 24 based on native glucagon corresponds to position 24 of (7-37) GLP-1.

In certain embodiments a glucagon superfamily peptide may comprise a C-terminus or a C-terminal amino acid sequence including but not limited to: COOH, $CONH_2$, GPSSGAPPPS (SEQ ID NO: 710), GPSSGAPPPS-$CONH_2$ (SEQ ID NO: 711), a oxyntomodulin carboxy terminal extension, KRNRNNIA (SEQ ID NO: 714) or KGKKNDWKH-NITQ (SEQ ID NO: 713). Additional, C-terminal amino acid sequences for glucagon superfamily peptides are further detailed below.

In other aspects, Q comprises osteocalcin (SEQ ID NO: 709), or an amino acid sequence that is at least about 40%, 45%, 50%, 55%, 60%, 65%, 70%, 75%, 80%, 85%, 90%, or 95% identical to native osteocalcin over the length of the native peptide. Q may comprise an analog of osteocalcin with up to 1, 2, 3, 4, 5, 6, 7, 8, 9 or 10 amino acid modifications relative to native osteocalcin. In yet other aspects, Q comprises growth hormone releasing hormone (GHRH) (SEQ ID NO: 719), or an amino acid sequence that is at least about 40%, 45%, 50%, 55%, 60%, 65%, 70%, 75%, 80%, 85%, 90%, or 95% identical to native GHRH over the length of the native peptide. Q may comprise an analog of GHRH with up to 1, 2, 3, 4, 5, 6, 7, 8, 9 or 10 amino acid modifications relative to native GHRH. In some embodiments, Q may be any analog of osteocalcin or GHRH known in the art.

In a further embodiments, there is provided a prodrug having the general structure of A-B-Q, wherein Q is a glucagon superfamily peptide, osteocalcin or an analog, derivative or conjugate thereof and A-B comprises the general structure:

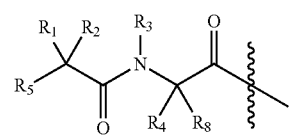

I wherein $R_1$ and $R_8$ are independently selected from the group consisting of H and $C_1$-$C_8$ alkyl;

$R_2$ and $R_4$ are independently selected from the group consisting of H, $C_1$-$C_8$ alkyl, $C_2$-$C_8$ alkenyl, ($C_1$-$C_4$ alkyl)OH, ($C_1$-$C_4$ alkyl)SH, ($C_2$-$C_3$ alkyl)$SCH_3$, ($C_1$-$C_4$ alkyl)$CONH_2$, ($C_1$-$C_4$ alkyl)COOH, ($C_1$-$C_4$ alkyl)$NH_2$, ($C_1$-$C_4$ alkyl)NHC($NH_2^+$)$NH_2$, ($C_0$-$C_4$ alkyl)($C_3$-$C_6$ cycloalkyl), ($C_0$-$C_4$ alkyl) ($C_6$-$C_{10}$ aryl)$R_7$, $CH_2$($C_5$-$C_9$ heteroaryl), or $R_1$ and $R_2$ together with the atoms to which they are attached form a $C_3$-$C_6$ cycloalkyl;

$R_3$ is selected from the group consisting of $C_1$-$C_8$ alkyl, ($C_1$-$C_4$ alkyl)OH, ($C_1$-$C_4$ alkyl)$NH_2$, ($C_1$-$C_4$ alkyl)SH, ($C_3$-$C_6$)cycloalkyl or $R_4$ and $R_3$ together with the atoms to which they are attached form a 5 or 6 member heterocyclic ring;

$R_5$ is $NHR_6$ or OH;

$R_6$ is H, or $R_6$ and $R_2$ together with the atoms to which they are attached form a 5 or 6 member heterocyclic ring; and $R_7$ is selected from the group consisting of H and OH.

Provided that when $R_4$ and $R_3$ together with the atoms to which they are attached form a 5 or 6 member heterocyclic ring, both $R_1$ and $R_2$ are other than H.

In other embodiments, there is provided a prodrug having the general structure of A-B-Q, wherein Q is a glucagon superfamily peptide, osteocalcin or an analog, derivative or conjugate thereof and A-B comprises the general structure:

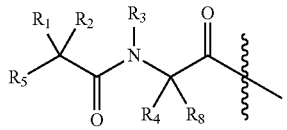

wherein $R_1$ and $R_8$ are independently H or $C_1$-$C_8$ alkyl;

$R_2$ and $R_4$ are independently selected from the group consisting of H, $C_1$-$C_8$ alkyl, $C_2$-$C_8$ alkenyl, ($C_1$-$C_4$ alkyl)OH, ($C_1$-$C_4$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2^+$)NH$_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl)$R_7$, and CH$_2$($C_3$-$C_9$ heteroaryl), or $R_1$ and $R_2$ together with the atoms to which they are attached form a $C_3$-$C_{12}$ cycloalkyl;

$R_3$ is selected from the group consisting of $C_1$-$C_8$ alkyl, ($C_1$-$C_4$ alkyl)OH, ($C_1$-$C_4$ alkyl)NH$_2$, ($C_1$-$C_4$ alkyl)SH, ($C_3$-$C_6$)cycloalkyl or $R_4$ and $R_3$ together with the atoms to which they are attached form a 5 or 6 member heterocyclic ring;

$R_5$ is NHR$_6$ or OH;

$R_6$ is H, $C_1$-$C_8$ alkyl, or $R_6$ and $R_2$ together with the atoms to which they are attached form a 5 or 6 member heterocyclic ring; and $R_7$ is selected from the group consisting of hydrogen, $C_1$-$C_{18}$ alkyl, $C_2$-$C_{18}$ alkenyl, ($C_0$-$C_4$ alkyl)CONH$_2$, ($C_0$-$C_4$ alkyl)COOH, ($C_0$-$C_4$ alkyl)NH$_2$, ($C_0$-$C_4$ alkyl)OH, halo, provided that when $R_4$ and $R_3$ together with the atoms to which they are attached form a 5 or 6 member heterocyclic ring, both $R_1$ and $R_2$ are not H.

In some embodiments Q is a peptide selected from the group consisting of Growth Hormone Releasing Hormone (GHRH; SEQ ID NO: 719), vasoactive intestinal peptide (VIP; SEQ ID NO: 720), Pituitary adenylate cyclase-activating polypeptide 27 (PACAP-27; SEQ ID NO: 721), peptide histidine methionine (PHM; SEQ ID NO: 722), or Secretin (SEQ ID NO: 723), glucagon (SEQ ID NO: 701), exendin-4 (SEQ ID NO: 718), Glucagon-like peptide-1 (GLP-1) (amino acids 7-37 provided as SEQ ID NOs: 703 and 704), Glucagon-like peptide-2 (GLP-2) (SEQ ID NO: 708), GIP (SEQ ID NO: 707), or analogs, derivatives and conjugates of the foregoing. In some embodiments, Q is a glucagon related peptide.

In another embodiment a prodrug analog of a glucagon superfamily peptide, or osteocalcin, or an analog, derivative or conjugate thereof, is provided wherein the prodrug moiety (A-B) is covalently linked to Q at one or more internal amino acid residues in the sequence of Q, e.g., at a position of Q corresponding to position 12, 16, 17, 18, 20, 28, or 29 of native glucagon (SEQ ID NO: 701). For example, in certain embodiments the prodrug moiety (A-B) is linked, directly or via a linker, to a substituted Lys at position 20 of Q. In such embodiments, Q may comprise at position 20 (relative to the native glucagon sequence), a substitution comprising the structure:

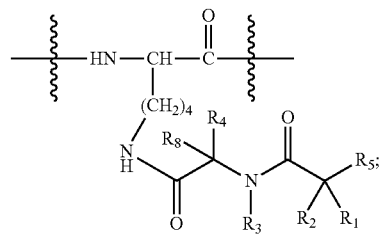

In other embodiments, the prodrug moiety (A-B) is linked, directly or via a linker, to a substituted amino-Phe at position 22. In such embodiments, Q may comprise at position 22 (relative to the native glucagon sequence), a substitution comprising the structure:

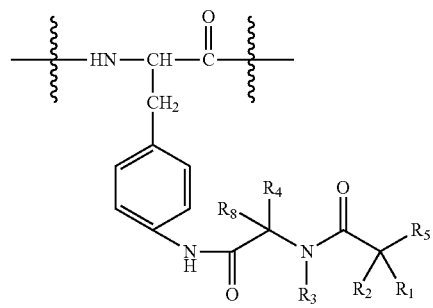

Alternatively or additionally, the prodrug moiety (A-B) is linked, directly or via a linker, to the amino terminus of Q, wherein A-B comprises the structure:

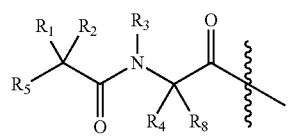

I wherein $R_1$ and $R_8$ are independently selected from the group consisting of H and $C_1$-$C_8$ alkyl;

$R_2$ and $R_4$ are independently selected from the group consisting of H, $C_1$-$C_8$ alkyl, $C_2$-$C_8$ alkenyl, ($C_1$-$C_4$ alkyl)OH, ($C_1$-$C_4$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2^+$)NH$_2$, ($C_0$-$C_4$ alkyl)($C_3$-$C_6$ cycloalkyl), ($C_0$-$C_4$ alkyl)($C_6$-$C_{10}$ aryl)$R_7$, CH$_2$($C_5$-$C_9$ heteroaryl), or $R_1$ and $R_2$ together with the atoms to which they are attached form a $C_3$-$C_6$ cycloalkyl;

$R_3$ is selected from the group consisting of $C_1$-$C_8$ alkyl, ($C_1$-$C_4$ alkyl)OH, ($C_1$-$C_4$ alkyl)NH$_2$, ($C_1$-$C_4$ alkyl)SH, ($C_3$-$C_6$)cycloalkyl or $R_4$ and $R_3$ together with the atoms to which they are attached form a 5 or 6 member heterocyclic ring;

$R_5$ is NHR$_6$ or OH;

$R_6$ is H, or $R_6$ and $R_2$ together with the atoms to which they are attached form a 5 or 6 member heterocyclic ring; and $R_7$ is selected from the group consisting of H and OH, with the proviso that $R_1$ and $R_2$ are each other than H when $R_4$ and $R_3$ together with the atoms to which they are attached form a 5 or 6 member heterocyclic ring.

In other embodiments, the prodrug moiety (A-B) is linked, directly or via a linker, to the amino terminus of Q, wherein A-B comprises the structure:

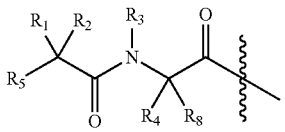

I wherein

R$_1$ and R$_8$ are independently H or C$_1$-C$_8$ alkyl;

R$_2$ and R$_4$ are independently selected from the group consisting of H, C$_1$-C$_8$ alkyl, C$_2$-C$_8$ alkenyl, (C$_1$-C$_4$ alkyl)OH, (C$_1$-C$_4$ alkyl)SH, (C$_2$-C$_3$ alkyl)SCH$_3$, (C$_1$-C$_4$ alkyl)CONH$_2$, (C$_1$-C$_4$ alkyl)COOH, (C$_1$-C$_4$ alkyl)NH$_2$, (C$_1$-C$_4$ alkyl)NHC (NH$_2$+)NH$_2$, (C$_0$-C$_4$ alkyl)(C$_3$-C$_6$ cycloalkyl), (C$_0$-C$_4$ alkyl) (C$_2$-C$_5$ heterocyclic), (C$_0$-C$_4$ alkyl)(C$_6$-C$_{10}$ aryl)R$_7$, and CH$_2$ (C$_3$-C$_9$ heteroaryl), or R$_1$ and R$_2$ together with the atoms to which they are attached form a C$_3$-C$_{12}$ cycloalkyl;

R$_3$ is selected from the group consisting of C$_1$-C$_8$ alkyl, (C$_1$-C$_4$ alkyl)OH, (C$_1$-C$_4$ alkyl)NH$_2$, (C$_1$-C$_4$ alkyl)SH, (C$_3$-C$_6$)cycloalkyl or R$_4$ and R$_3$ together with the atoms to which they are attached form a 5 or 6 member heterocyclic ring;

R$_5$ is NHR$_6$ or OH;

R$_6$ is H, C$_1$-C$_8$ alkyl, or R$_6$ and R$_2$ together with the atoms to which they are attached form a 5 or 6 member heterocyclic ring; and R$_7$ is selected from the group consisting of hydrogen, C$_1$-C$_{18}$ alkyl, C$_2$-C$_{18}$ alkenyl, (C$_0$-C$_4$ alkyl)CONH$_2$, (C$_0$-C$_4$ alkyl)COOH, (C$_0$-C$_4$ alkyl)NH$_2$, (C$_0$-C$_4$ alkyl)OH, halo, with the proviso that R$_1$ and R$_2$ are both not H when R$_4$ and R$_3$ together with the atoms to which they are attached form a 5 or 6 member heterocyclic ring.

In some embodiments, only one prodrug moiety is linked to Q. For example, in such embodiments, when the prodrug moiety (A-B) is linked to Q at the N-terminus, there are no prodrug moieties (A-B) linked to an internal amino acid residue in the sequence of Q, and vice versa. In some embodiments, two or three prodrug moieties are linked to Q, e.g. at the N-terminus and at one or more internal sites.

(A) Peptide A, (at 15 ◁ or 70 ◀ nmol/kg/day), (B) Lys$^{-1}$ Sar$^0$ Peptide A, (at 15 ▷ or 70 ▶ nmol/kg/day), or (C) dLys$^{-1}$ Sar$^0$ Peptide A, (at 15 □, or 70 ■ nmol/kg/day).

A saline solution comprising 25% (v/v) glucose was injected at a dose of 1.5 g/kg of body weight at the 0 min time point. Blood glucose levels were measured at the –60, 0, 15, 30, 60, and 120 min time points.

Figure 4:
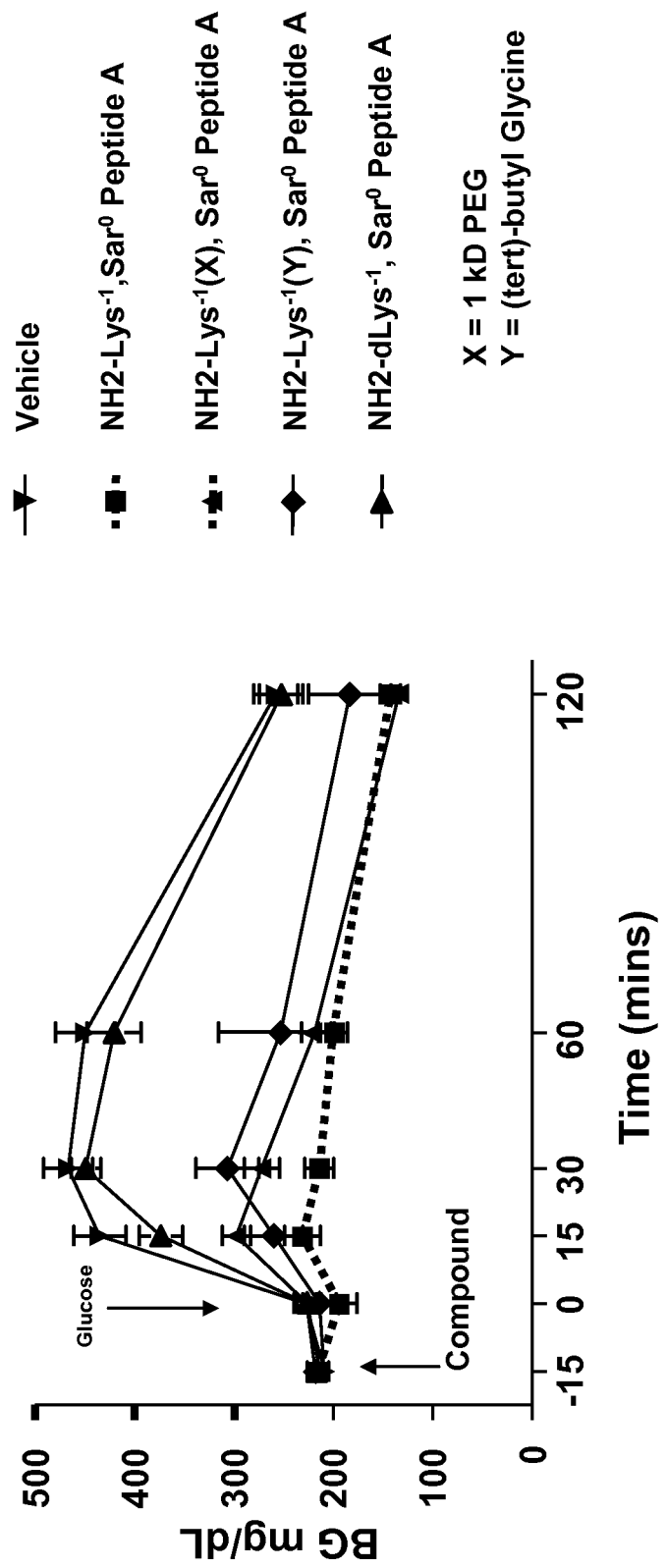

FIG. 4 is a graph of blood glucose levels (mg/dL) in DIO mice (N=8) injected first with a glucagon related peptide and then a glucose solution. Mice were injected intraperitoneally at the –15 min time point with either vehicle only (▼) or a 2 nmol/kg dose of one of the following compounds:

(A) Lys$^{-1}$ Sar$^0$ Peptide A (■), (B) Lys$^{-1}$(X), Sar$^0$ Peptide A (▲), (X representing a 1 K PEG chain linked to the Lys side chain)

(C) Lys$^{-1}$(Y), Sar$^0$ Peptide A (◆), (Y representing a tert-butyl glycine linked to the Lys side chain)

(D) dLys$^{-1}$ Sar$^0$ Peptide A, (▶).

A saline solution comprising 25% (v/v) glucose was injected at a dose of 1.5 g/kg of body weight at the 0 min time point. Blood glucose levels were measured at the –15, 0, 15, 30, 60, and 120 min time points.

Figure 5:
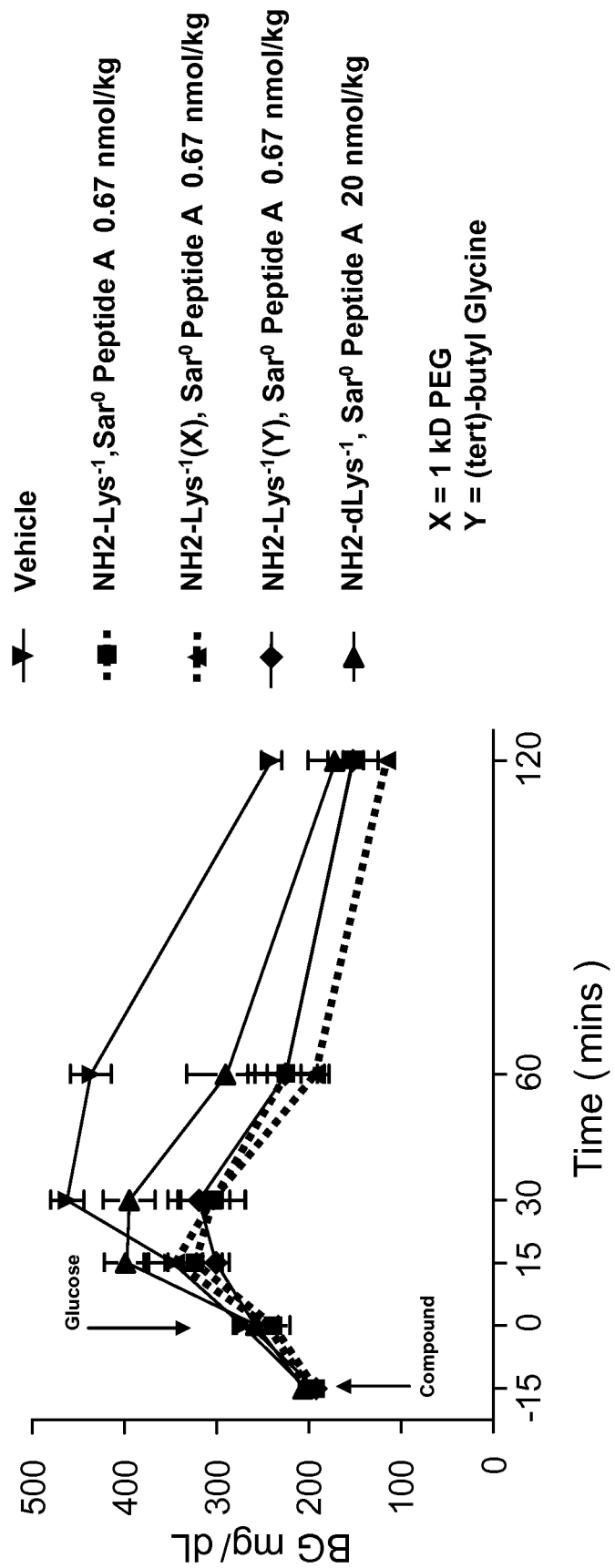

FIG. 5 is a graph of blood glucose levels (mg/dL) in DIO mice (N=8) injected first with a glucagon related peptide and then a glucose solution. Mice were injected intraperitoneally at the –15 min time point with either vehicle (▼), a 20 nmol/kg dose for dLys$^{-1}$ Sar$^0$ Peptide A (▶), or a 0.67 nmol/kg dose of one of the following compounds:

(A) Lys$^{-1}$ Sar$^0$ Peptide A (■), (B) Lys$^{-1}$(X), Sar$^0$ Peptide A (▲), (X representing a 1 K PEG chain linked to the Lys side chain)

(C) Lys$^{-1}$(Y), Sar$^0$ Peptide A (◆), (Y representing a tert-butyl glycine linked to the Lys side chain).

A saline solution comprising 25% (v/v) glucose was injected at a dose of 1.5 g/kg of body weight at the 0 min time point. Blood glucose levels were measured at the –15, 0, 15, 30, 60, and 120 min time points.

Figure 6:
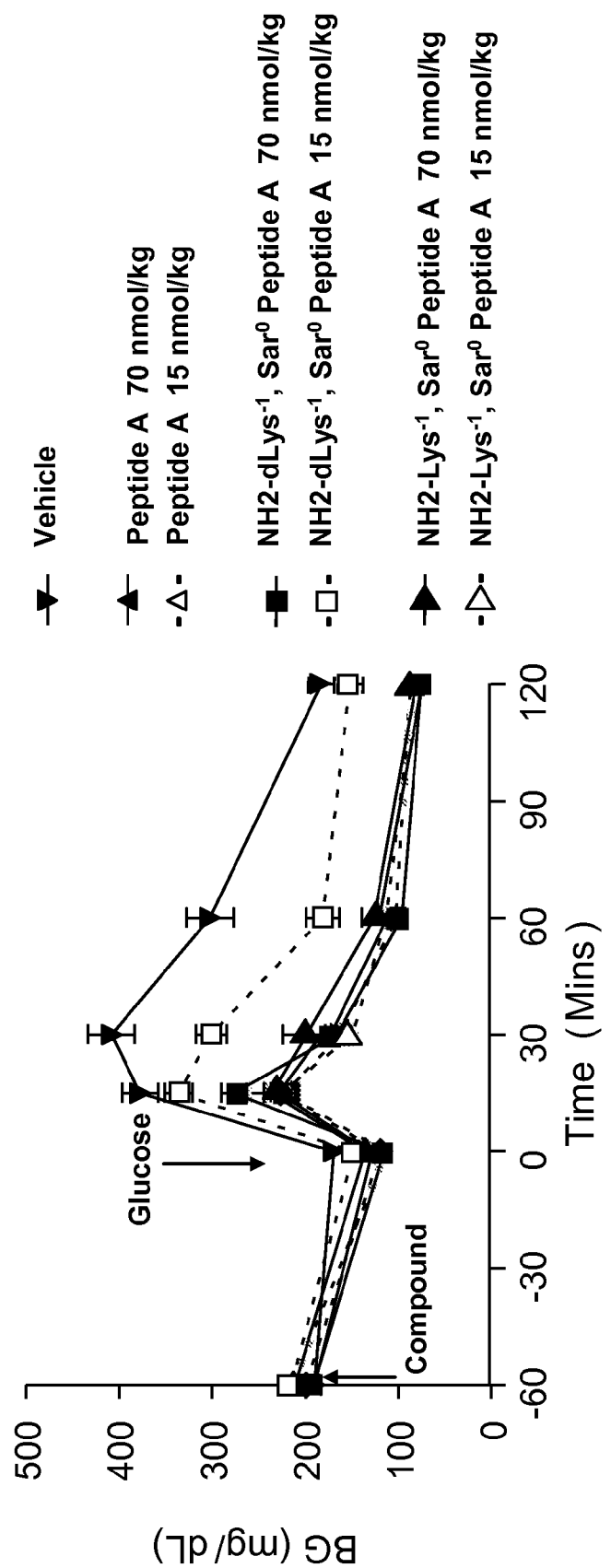

FIG. 6 is a graph of blood glucose levels (mg/dL) in DIO mice (N=8) injected first with a glucagon related peptide and then a glucose solution. Mice were injected intraperitoneally at the –60 min time point with either vehicle only (▼) or 15 or 70 nmol/kg dose of one of the following compounds:

(A) Peptide A, (at 15 △ or 70 ▲ nmol/kg/day), (B) dLys$^{-1}$ Sar$^0$ Peptide A, (at 15 □, or 70 ■ nmol/kg/day), or (C) Lys$^{-1}$ Sar$^0$ Peptide A, (at 15 ▷ or 70 ▶ nmol/kg/day).

A saline solution comprising 25% (v/v) glucose was injected at a dose of 1.5 g/kg of body weight at the 0 min time point and 24 hours later (see FIG. 7). Indicated blood glucose levels were measured at the –60, 0, 15, 30, 60, and 120 min time points relative to the first administration of the glucose solution (i.e., the 0 min time point).

Figure 7:
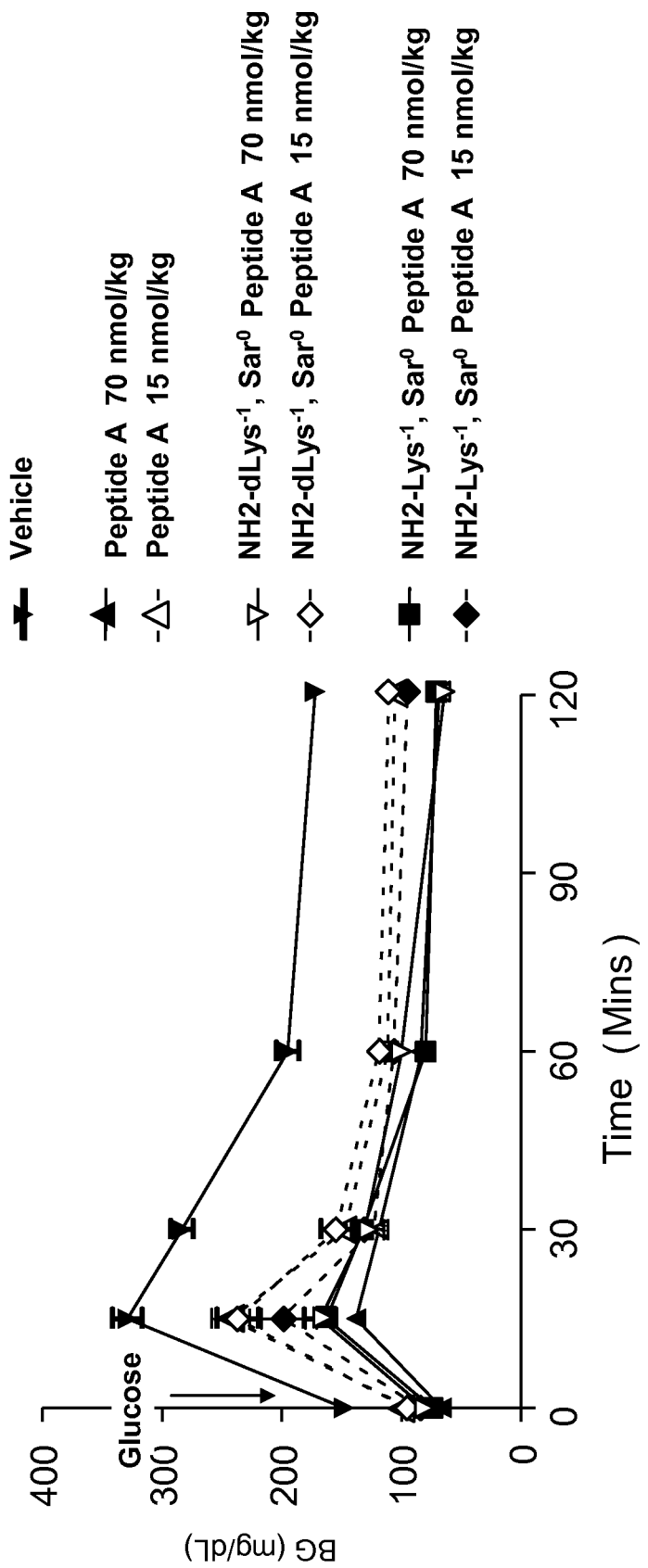

FIG. 7 is a graph of blood glucose levels (mg/dL) in DIO mice (N=8) injected intraperitoneally at the –60 min time point with either vehicle only (▼) or 15 or 70 nmol/kg dose of one of the following compounds:

(A) Peptide A, (at 15 △ or 70 ▲ nmol/kg/day), (B) dLys$^{-1}$ Sar$^0$ Peptide A, (at 15 ◇ or 70 ▽ nmol/kg/day), or (C) Lys$^{-1}$ Sar$^0$ Peptide A, (at 15 ◆, or 70 ■ nmol/kg/day).

A saline solution comprising 25% (v/v) glucose was injected at a dose of 1.5 g/kg of body weight at the 0 min time point and 24 hours later. Indicated blood glucose levels were measured at the 0, 15, 30, 60, and 120 min time points relative to the 24 hour administration of the second glucose solution.

Figure 8:
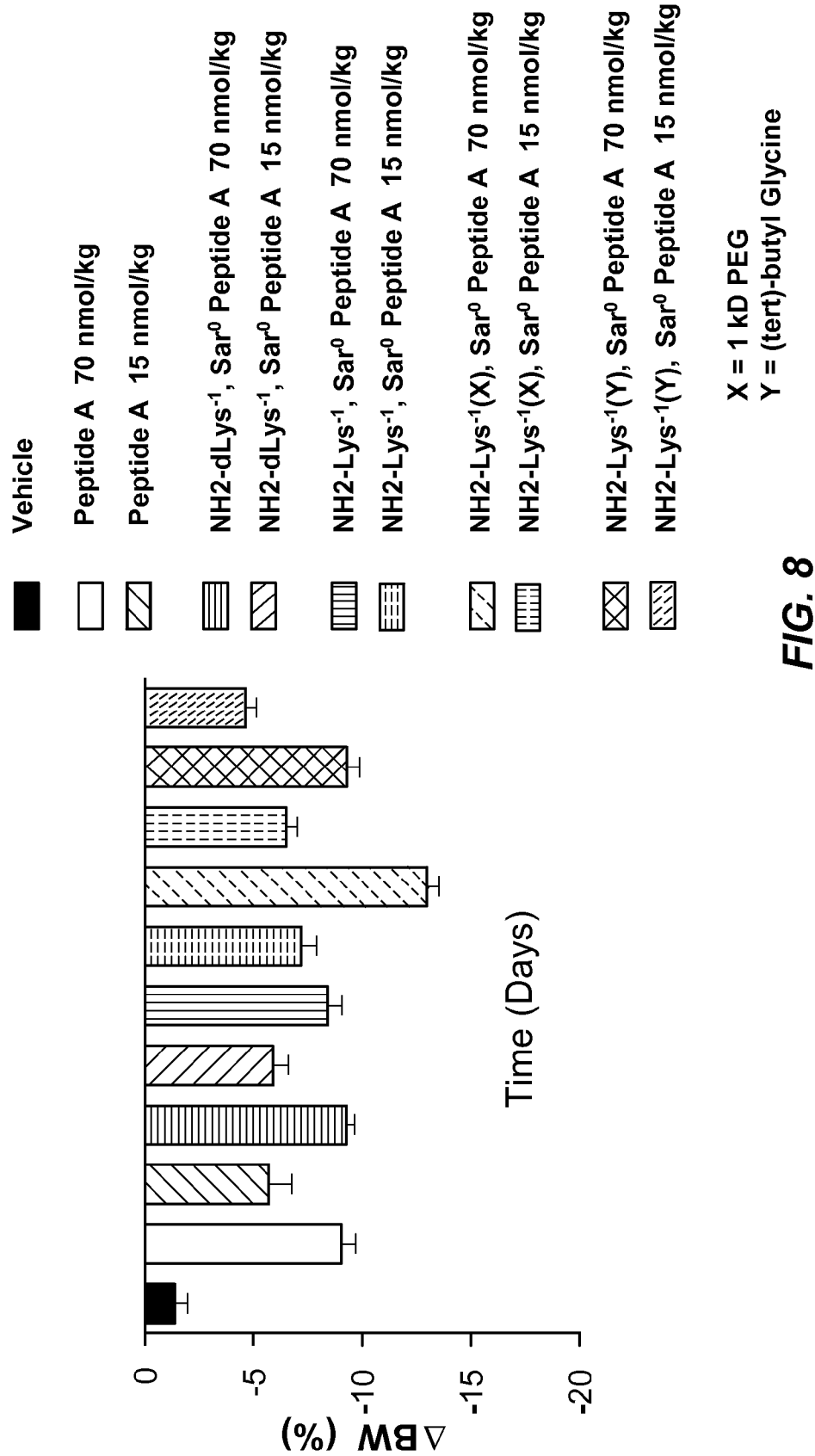

FIG. 8 present data indicating the weight loss in DIO mice (N=8) injected intraperitoneally with the indicated compounds at either a 15 or 70 nmol/kg dose. The indicated body weights were determined 7 days after administration of the compounds.

Figure 9A:
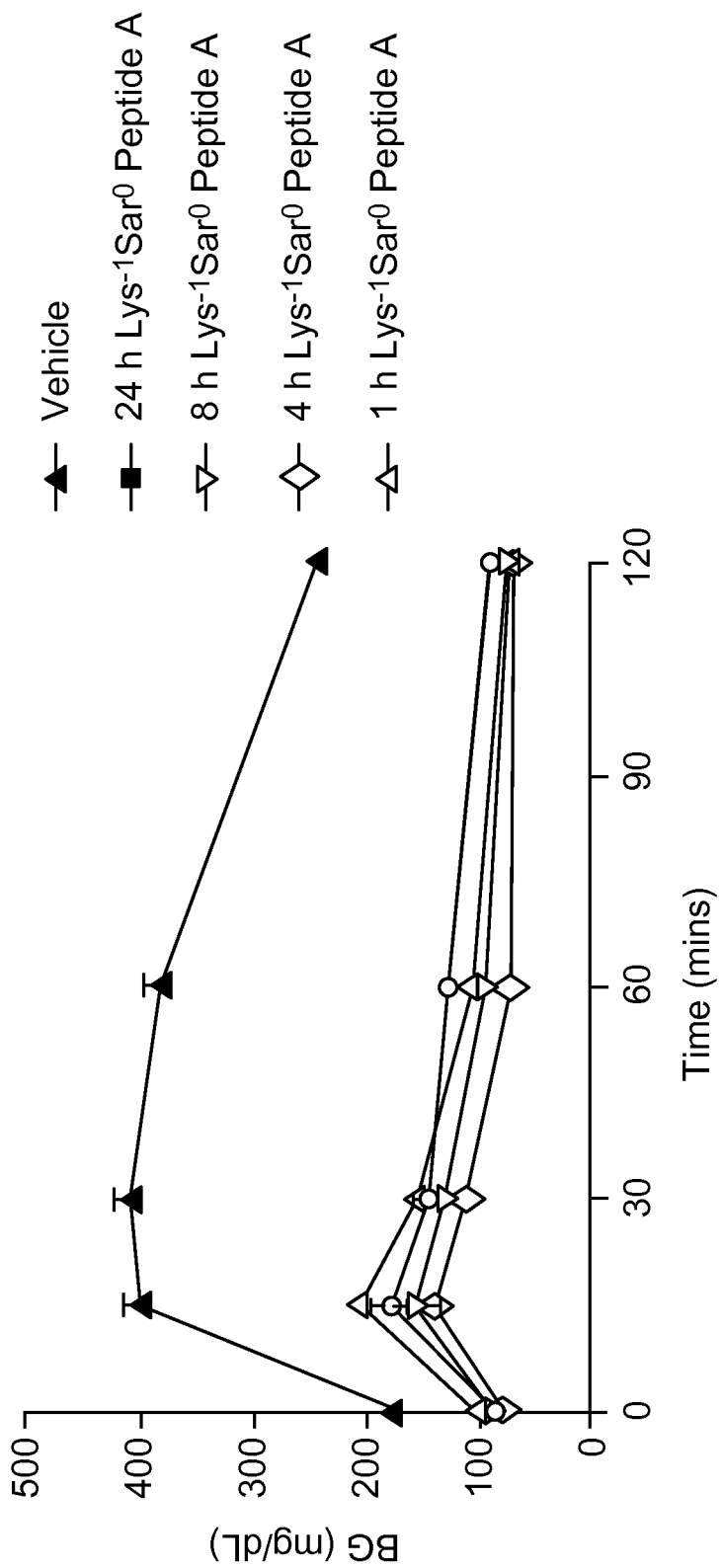
Figure 9B:
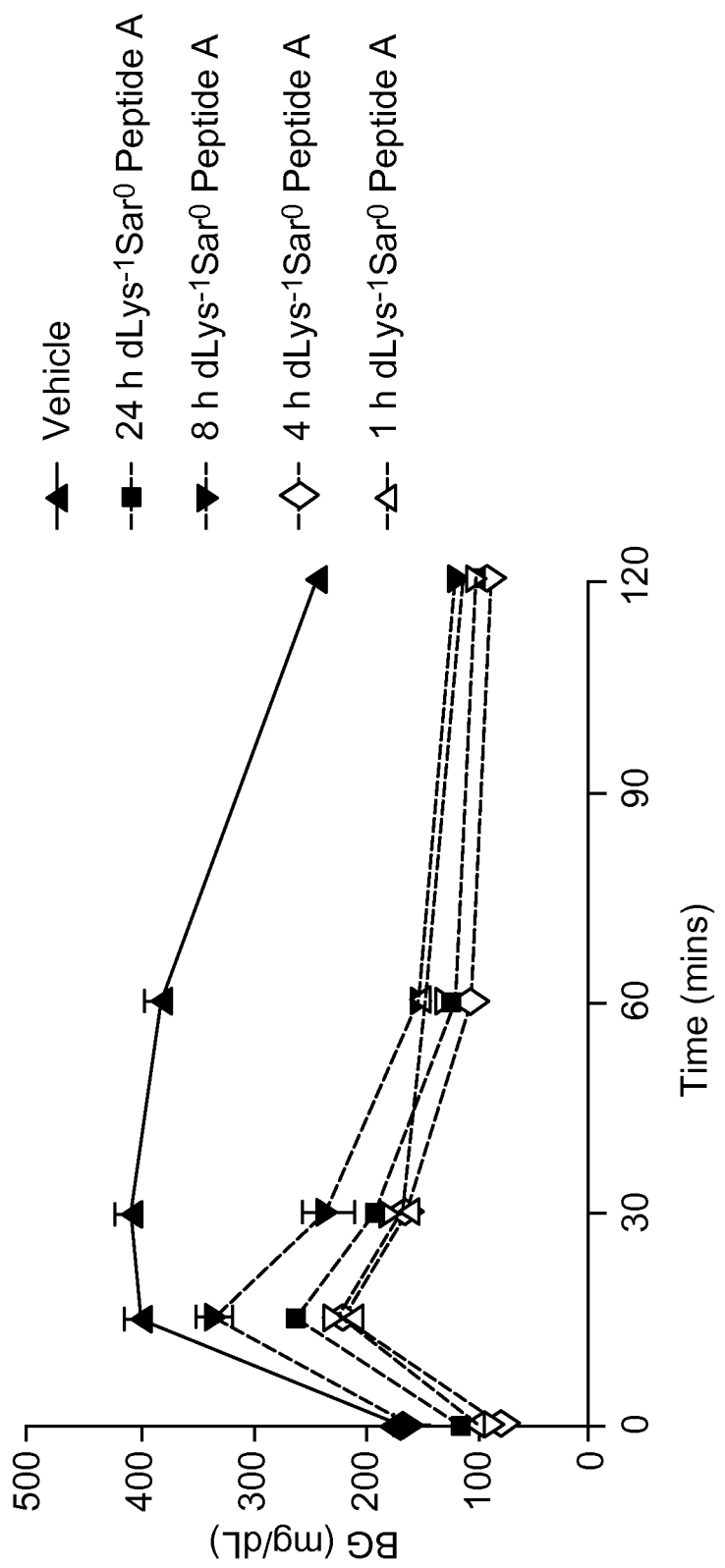

FIG. 9A-B present graphs of blood glucose (BG) levels (mg/dL) in DIO mice (n=8). Mice were injected intraperitoneally with vehicle only, or with prodrug peptide at 24, 8, 4, or 1 hour prior to challenge (as indicated in the figure) with an injection of 25% glucose in saline at 1.5 g/kg of body weight. Indicated blood glucose levels were measured at the 0, 15, 30, 60, and 120 min time points relative the challenge with glucose solution. FIG. 9A shows blood glucose levels following administration of $Lys^{-1}$ $Sar^0$ Peptide A (i.e., comprising a $Lys^{-1}$-$Sar^0$ prodrug element). FIG. 9B shows blood glucose levels following administration of $dLys^{-1}$ $Sar^0$ Peptide A (i.e., comprising a D-$Lys^{-1}$-$Sar^0$ prodrug element).

FIG. 10 presents an alignment of the amino acid sequences of various glucagon superfamily peptides or relevant fragments thereof. The amino acid sequence presented are GHRH (SEQ ID NO: 719), PHI (SEQ ID NO: 722), VIP (SEQ ID NO: 720), PACAP-27 (SEQ ID NO: 721), Exendin-4 (SEQ ID NO: 718), GLP-1 (SEQ ID NO: 703), Glucagon (SEQ ID NO: 701), Oxyntomodulin (SEQ ID NO: 706), GIP (SEQ ID NO: 707), GLP-2 (SEQ ID NO: 708) and Secretin (SEQ ID NO: 724).

Figure 11:
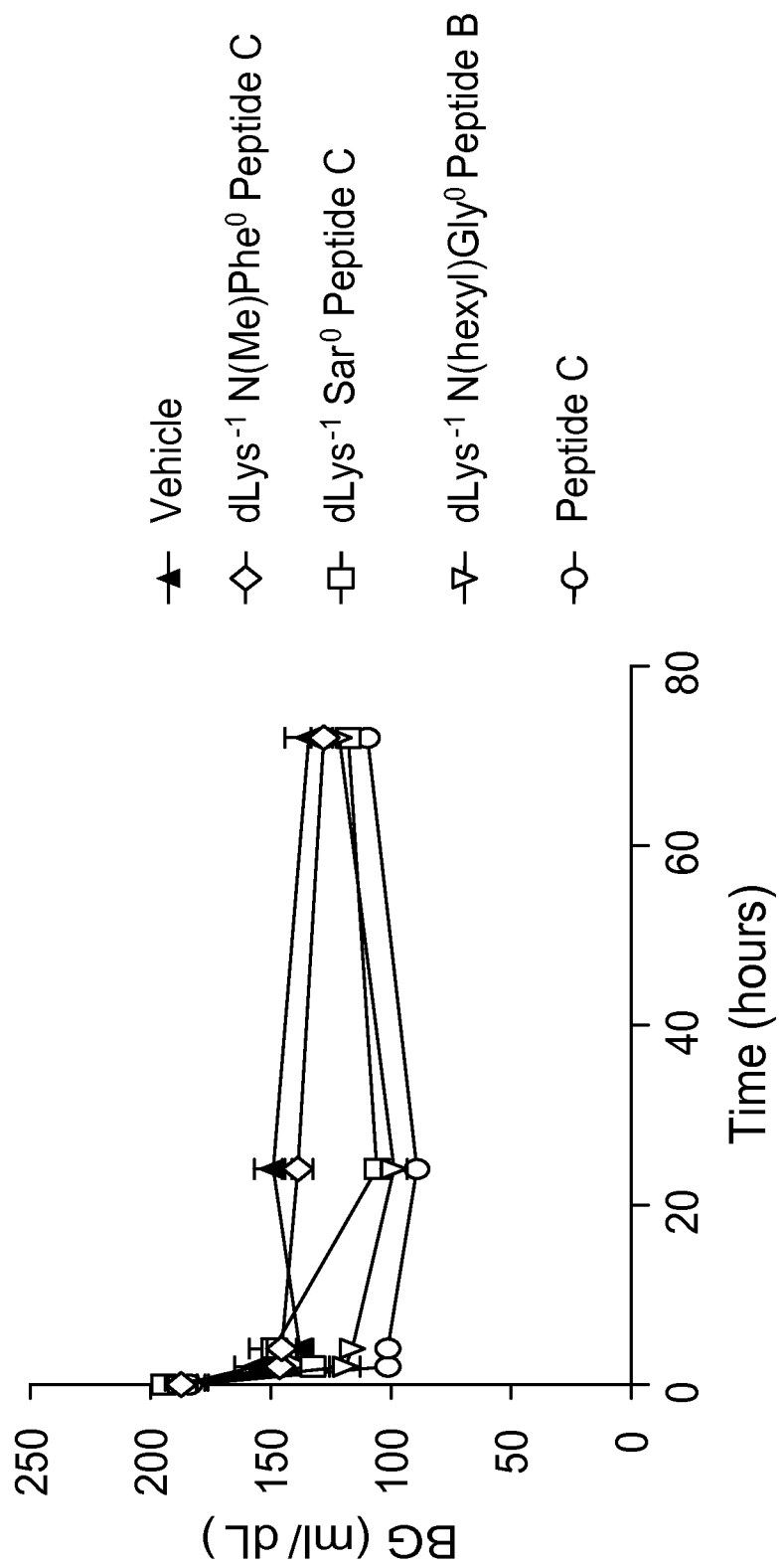

FIG. 11 presents a graph of blood glucose levels (mg/dL) in DIO mice (nine groups of eight mice) that were subcutaneously injected with a single dose of vehicle only or 10 nmol/kg of one of the following:

(A) Glucagon Superfamily Peptide C ("Peptide C"),
(B) dK-Sar-Peptide C,
(C) dK-Gly(N-Hexyl)-Glucagon Superfamily Peptide B ("Peptide B"), or
(D) dK-F(N-Me)-Peptide C.

The mice were 5.5 months old and had been on a high fat diet for approximately 2 months. Blood glucose levels were taken at 0, 2, 4, 24, and 72 hours post injection.

Figure 12:
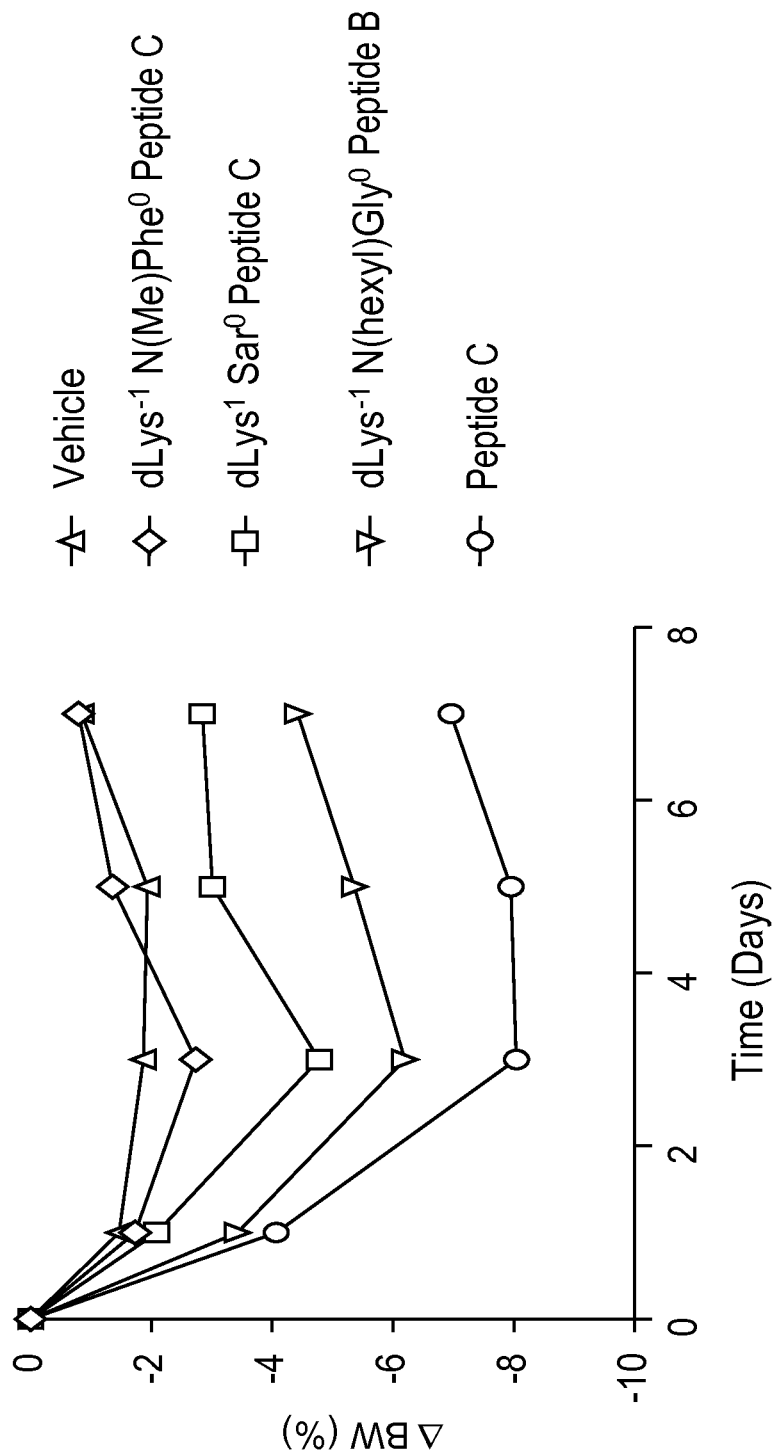

FIG. 12 presents a graph of the change in body weight in DIO mice (nine groups of eight mice) that were subcutaneously injected with a single dose of vehicle only or 10 nmol/kg of one of the following:

(A) Peptide C,
(B) dK-Sar-Peptide C,
(C) dK-Gly(N-Hexyl)-Peptide B, or
(D) dK-F(N-Me)-Peptide C.

The mice were 5.5 months old and had been on a high fat diet for approximately 2 months. Food intake and fat mass were monitored during the week long study.

Figure 13A:
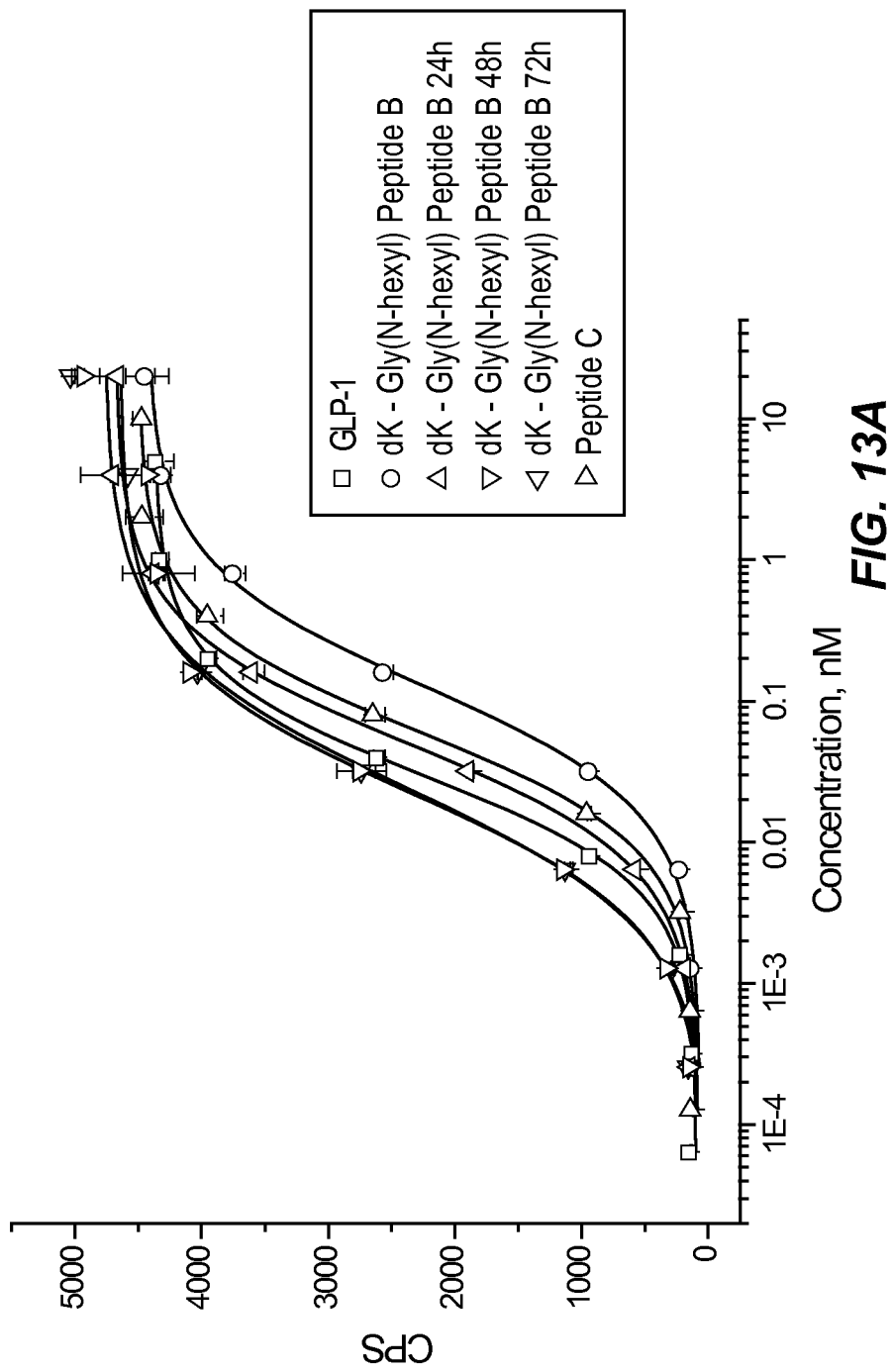
Figure 13B:
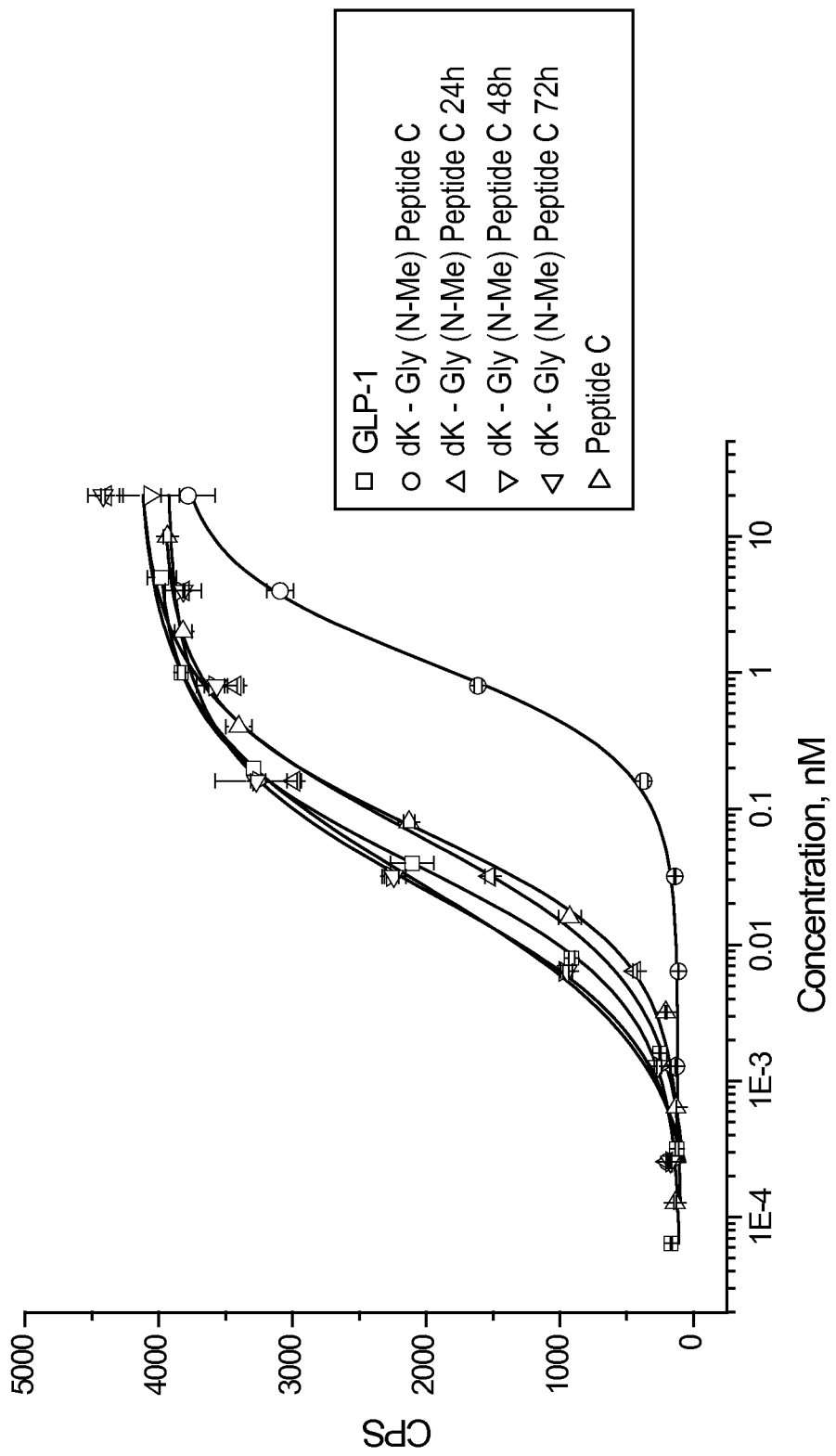

FIGS. 13A and 13B represent the receptor binding activity of dK-Gly(N-Hexyl)-Peptide B (FIG. 13A) and dK-Sar-Peptide C (FIG. 13B) in 20% human plasma as determined using the GLP-receptor Luciferase assay.

Figure 14:
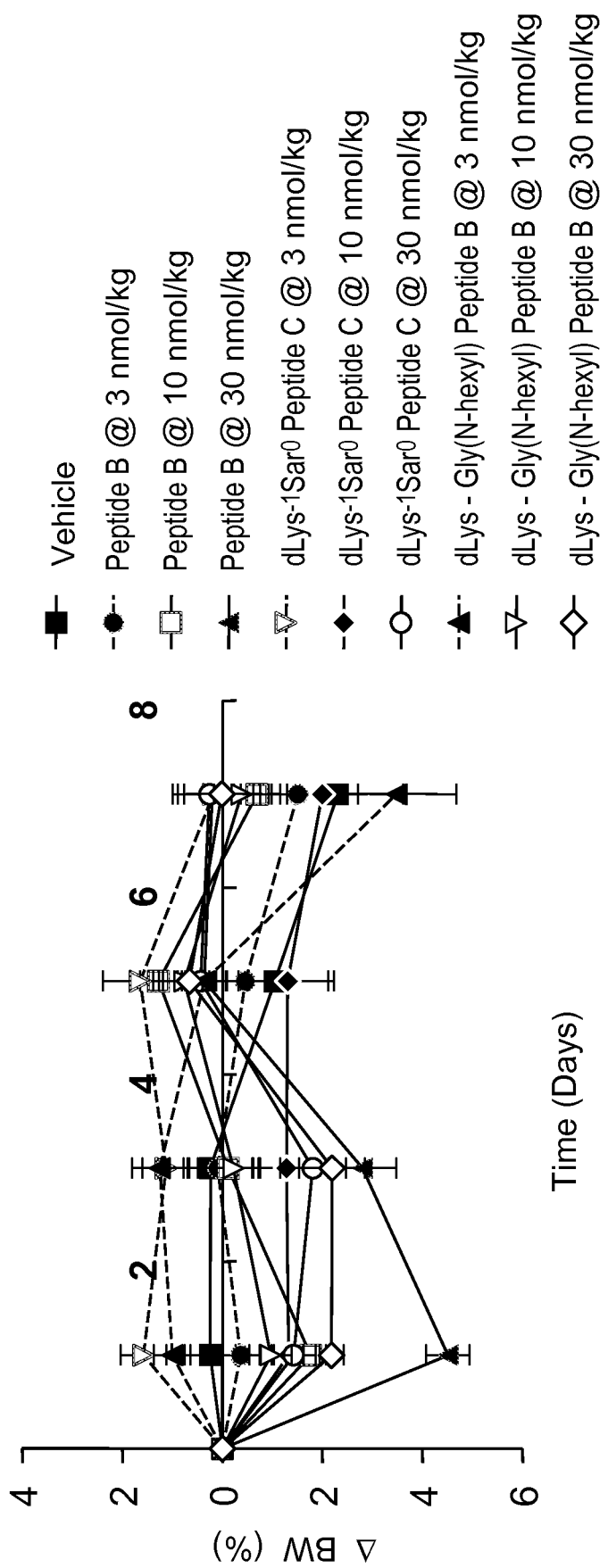

FIG. 14 presents a graph of the change in body weight in DIO mice (n=8) that were subcutaneously injected a single dose of 3, 10, or 30 nmol/kg of vehicle only or one of the following compounds:

(A) Peptide C,
(B) $dLys^{-1}$ $Sar^0$ Peptide C, or
(C) $dLys^{-1}$ Gly(N-Hexyl)$^0$ Peptide B.

Body weights were determined on days 1, 3, 5, and 7 of the study. The mice were 5 months old with an initial average body weight of 31.2 g, and had been on a regular chow diet for approximately 5 months.

Figure 15A:
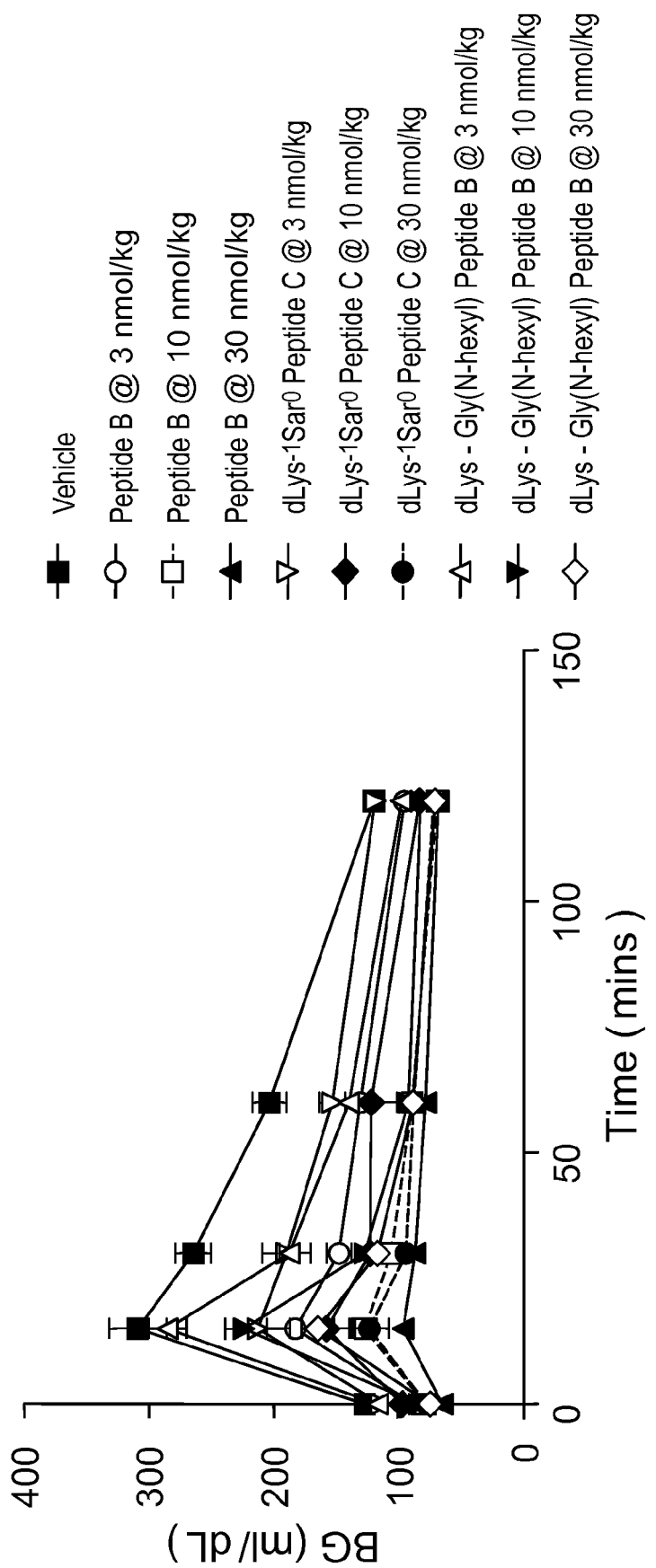
Figure 15B:
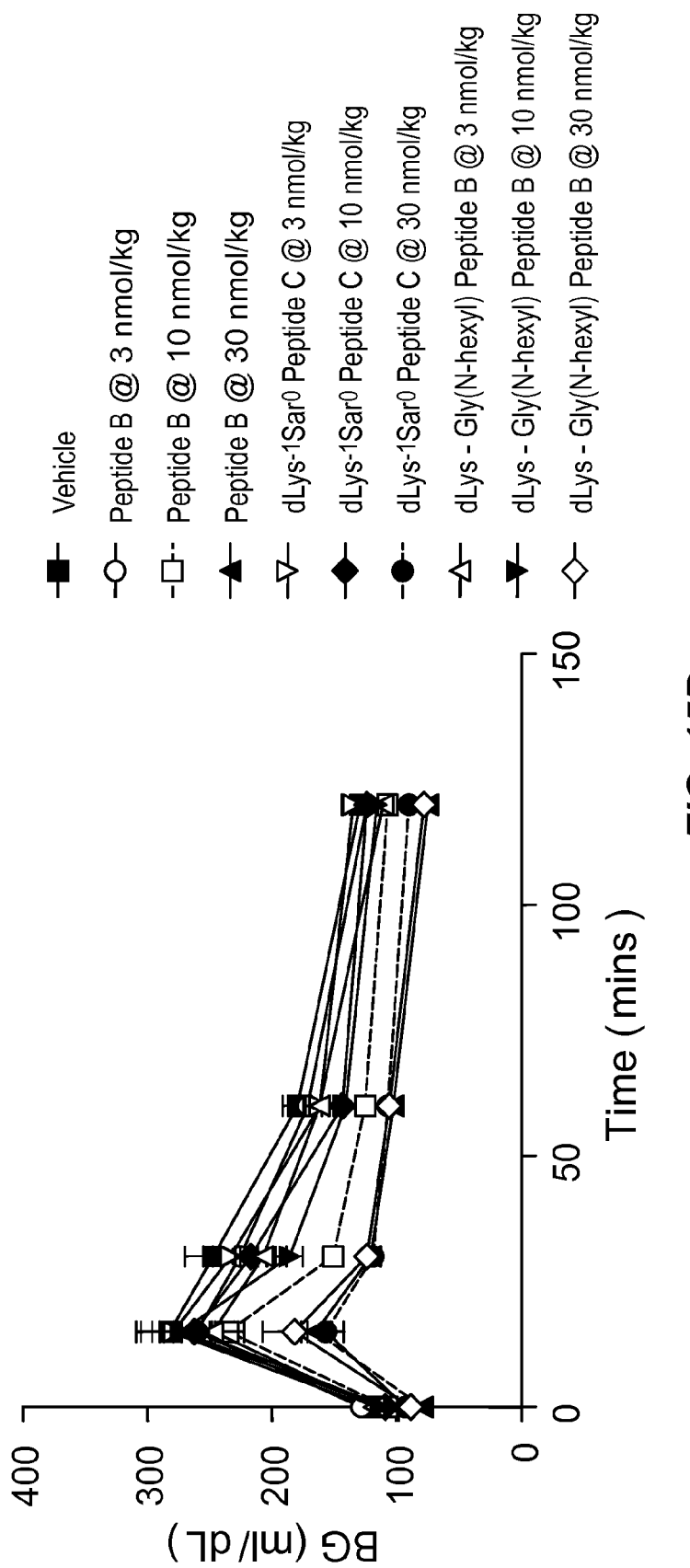
Figure 15C:
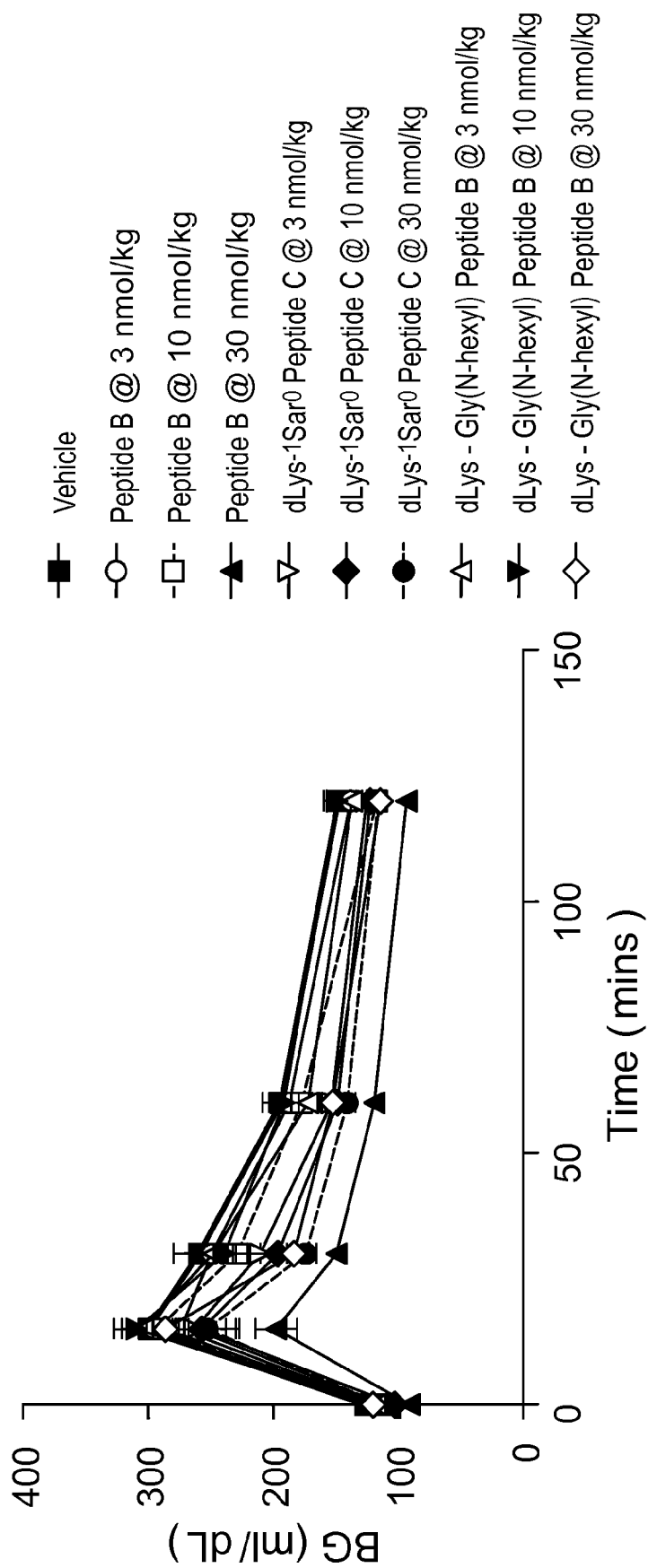

FIGS. 15A-C present graphs of blood glucose (BG) levels (mg/dL) in DIO mice (n=8) that were subcutaneously injected a single dose of 3, 10, or 30 nmol/kg of vehicle only or one of the following compounds:

(A) Peptide C,
(B) $dLys^{-1}$ $Sar^0$ Peptide C, or
(C) $dLys^{-1}$ Gly(N-Hexyl)$^0$ Peptide B.

Indicated blood glucose levels were taken intraperitoneally on days 1 (FIG. 15A), 3 (FIG. 15B), and 5 (FIG. 15C). The mice were 5 months old and had been on a regular chow diet for approximately 5 months.

Figure 16A:
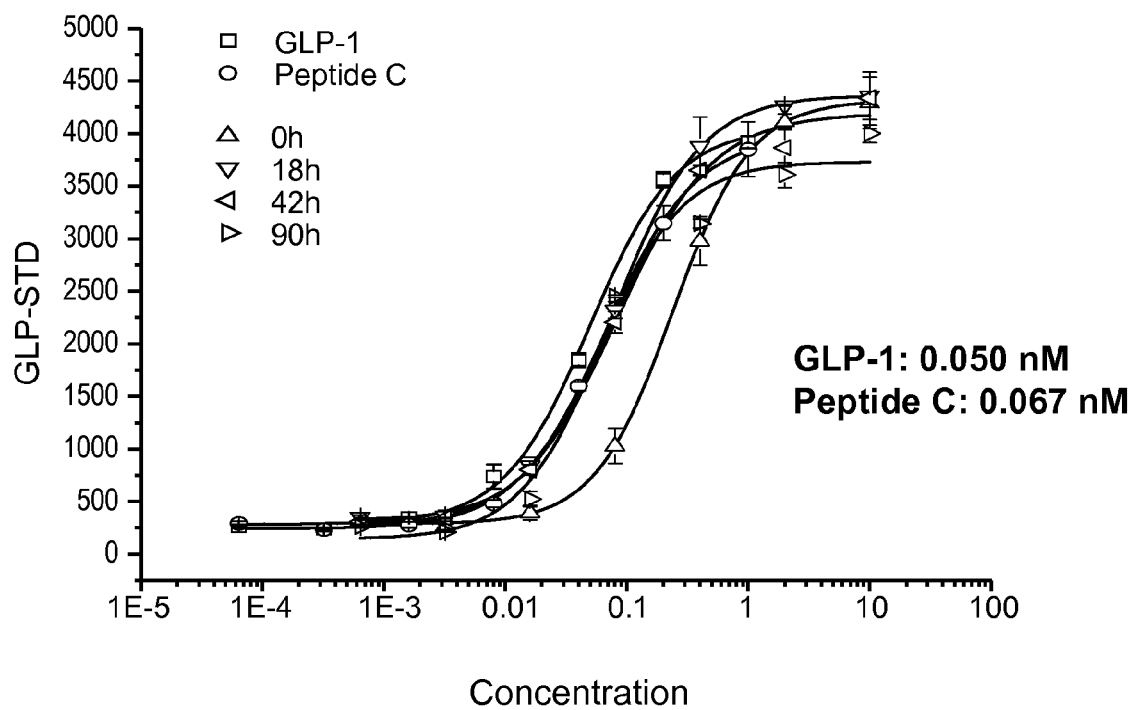
Figure 16B:
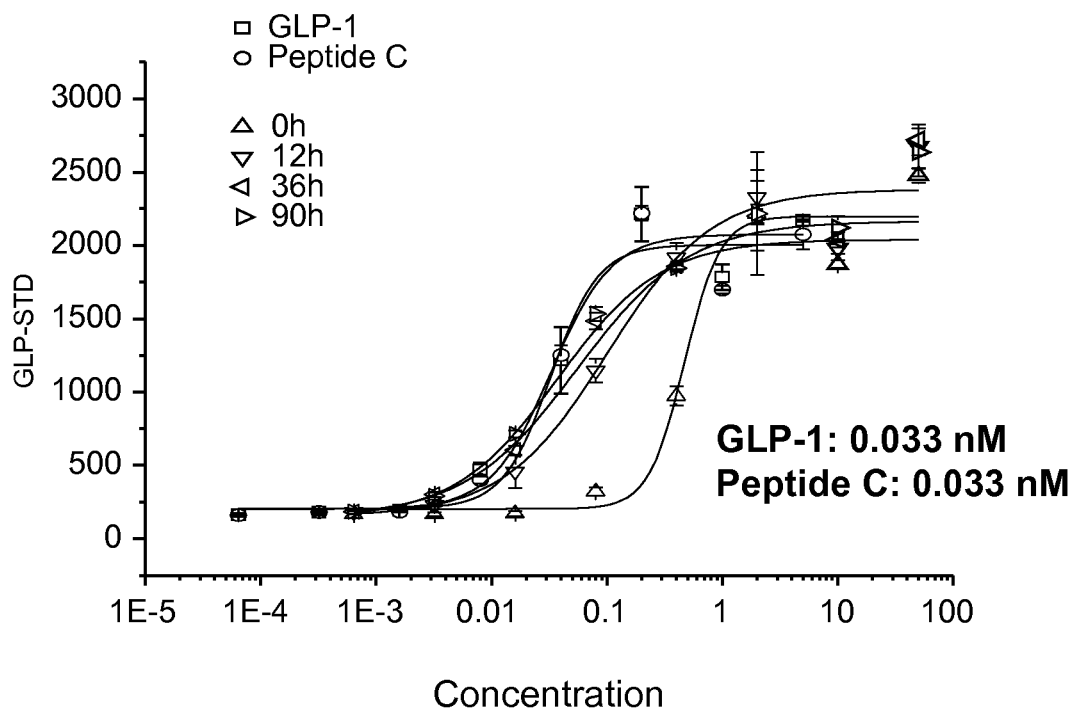
Figure 16C:
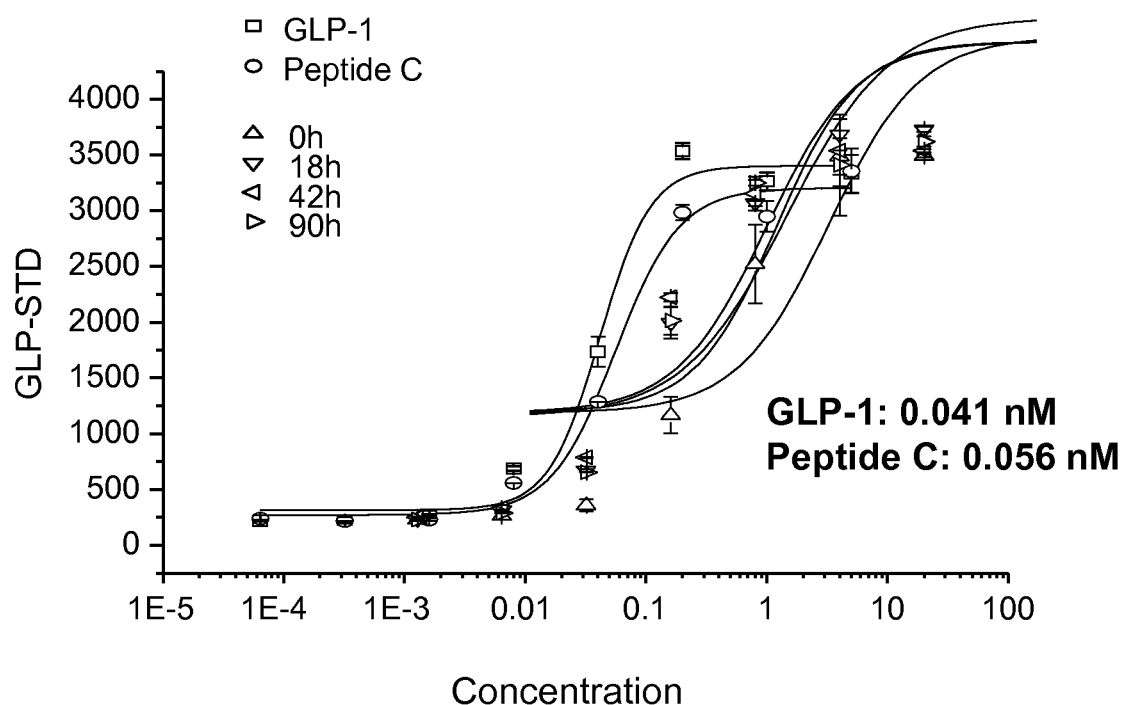
Figure 17A:
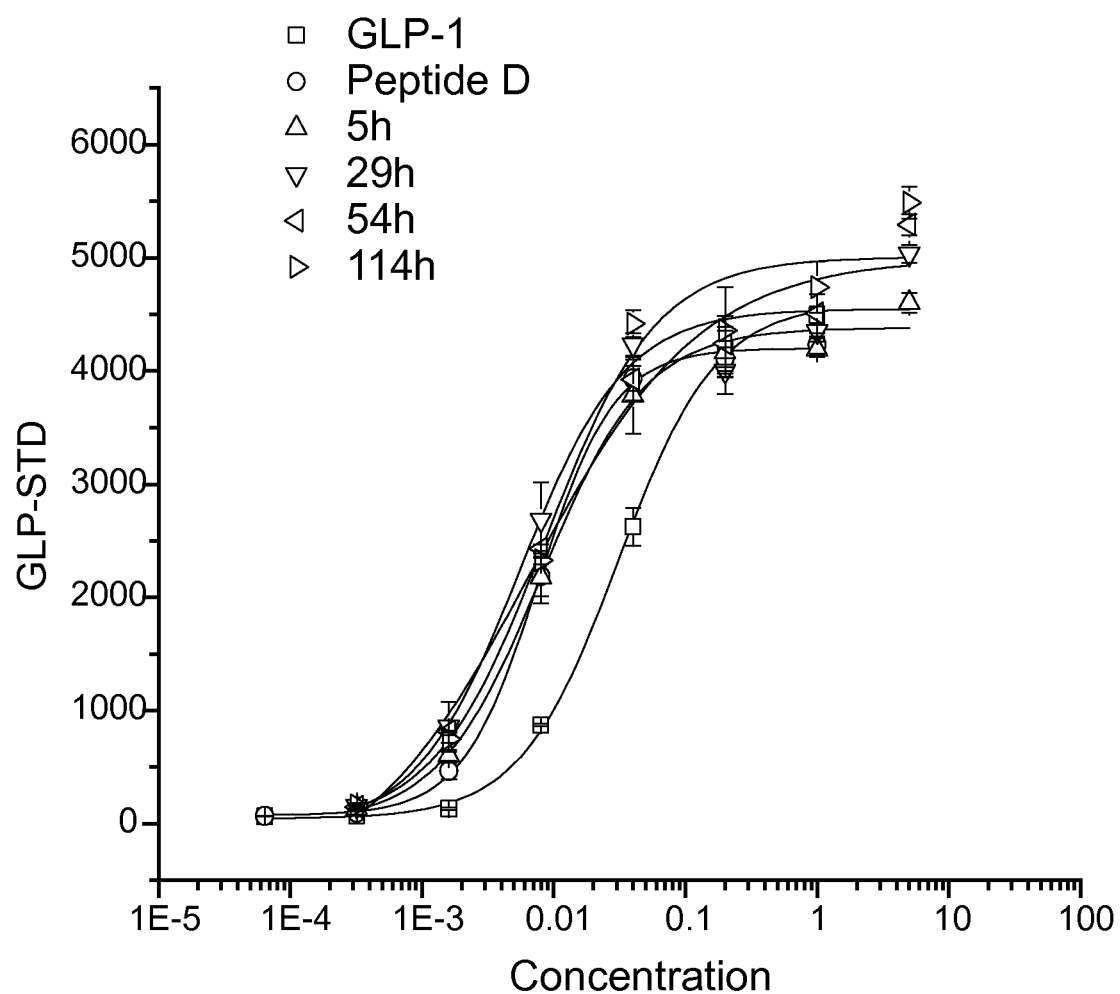
Figure 17B:
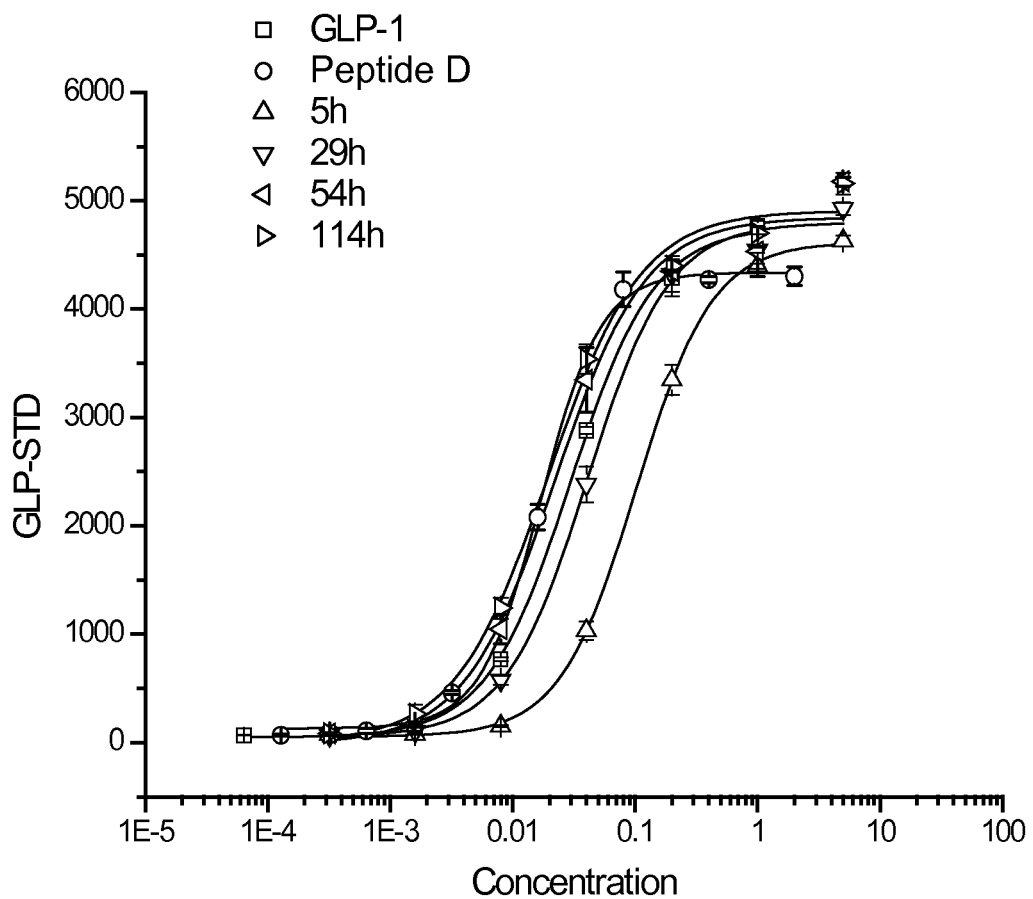
Figure 17C:
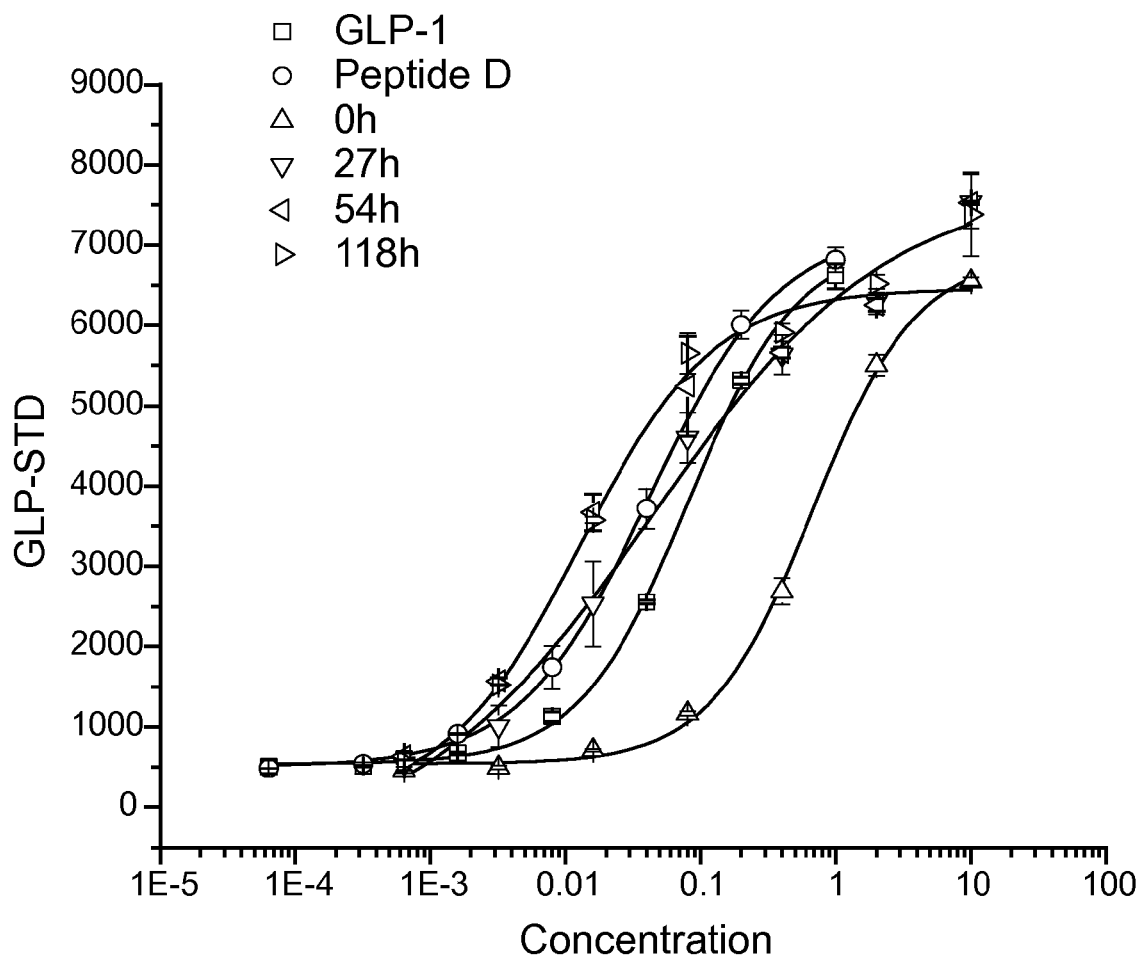
Figure 17D:
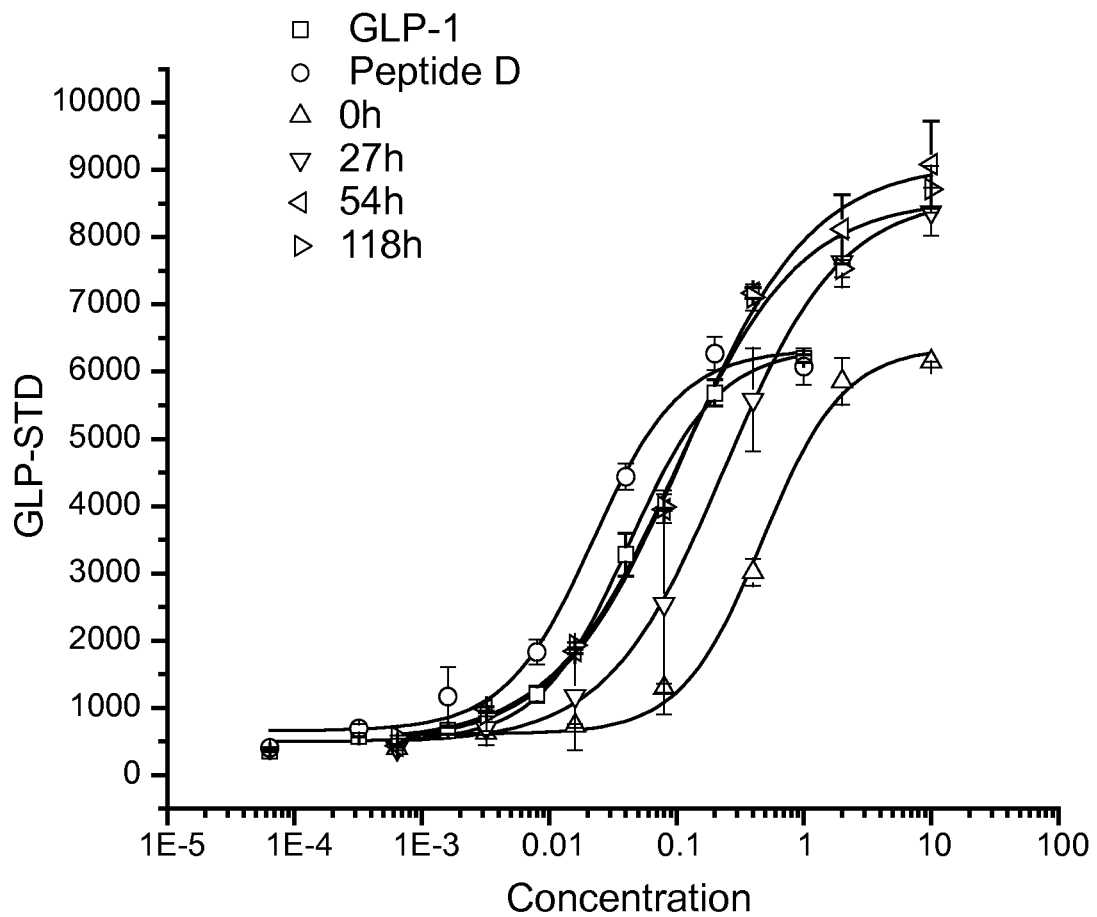

FIGS. 16A-16C represent the receptor binding activity of dLys-Gly(N-Hexyl)-Peptide C (FIG. 16A), dLys-Sar-Peptide C (FIG. 16B), and dLys-Phe(N-Methyl)-Peptide C (FIG. 16C) in 20% human plasma as determined using the GLP-receptor Luciferase assay.

FIGS. 17A-17D represent the receptor binding activity of Aib-Sar-Peptide D (FIG. 17A), dLys-Sar-Peptide D (FIG. 17B), dK-Gly(N-Hexyl)-Peptide D (FIG. 17C), and dLys-Phe(N-Methyl)-Peptide D (FIG. 17E) in 20% human plasma as determined using the GLP-receptor Luciferase assay.

Figure 18:
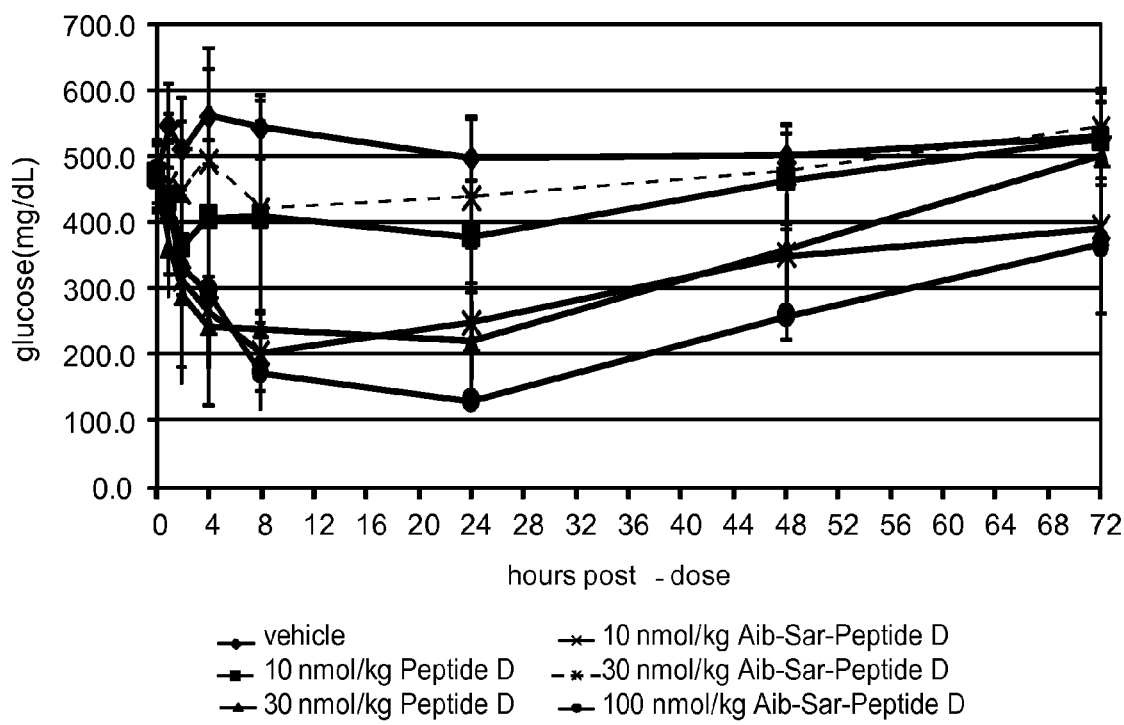

FIG. 18 represents a graph of the effect of a single subcutaneous dose of Peptide D and Aib-Sar-Peptide D at the indicated concentrations on blood glucose levels in mice over a 72-hour time course.

DETAILED DESCRIPTION

Definitions

In describing and claiming the invention, the following terminology will be used in accordance with the definitions set forth below.

As used herein, the term "prodrug" is defined as any compound that undergoes chemical modification before exhibiting its full pharmacological effects.

As used herein the term "amino acid" encompasses any molecule containing both amino and carboxyl functional groups, wherein the amino and carboxylate groups are attached to the same carbon (the alpha carbon). The alpha carbon optionally may have one or two further organic substituents. An amino acid can be designated by its three letter code, one letter code, or in some cases by the name of its side chain. For example, an unnatural amino acid comprising a cyclohexane group attached to the alpha carbon is termed "cyclohexane" or "cyclohexyl." For the purposes of the present disclosure designation of an amino acid without specifying its stereochemistry is intended to encompass either the L or D form of the amino acid, or a racemic mixture. However, in the instance where an amino acid is designated by its three letter code and includes a superscript number (i.e., $Lys^{-1}$), such a designation is intended to specify the native L form of the amino acid, whereas the D form will be specified by inclusion of a lower case d before the three letter code and superscript number (i.e., $dLys^{-1}$).

As used herein the term "hydroxyl acid" refers to an amino acid that has been modified to replace the alpha carbon amino group with a hydroxyl group.

As used herein the term "non-coded amino acid" encompasses any amino acid that is not an L-isomer of any of the following 20 amino acids: Ala, Cys, Asp, Glu, Phe, Gly, His, Ile, Lys, Leu, Met, Asn, Pro, Gln, Arg, Ser, Thr, Val, Trp, Tyr.

A "dipeptide" is the result of the linkage of an α-amino acid or α-hydroxyl acid to another amino acid, through a peptide bond.

As used herein the term "chemical cleavage" absent any further designation encompasses a non-enzymatic reaction that results in the breakage of a covalent chemical bond.

A "bioactive polypeptide" refers to polypeptides which are capable of exerting a biological effect in vitro and/or in vivo.

As used herein an "acylated" amino acid is an amino acid comprising an acyl group which is non-native to a naturally-occurring amino acid, regardless by the means by which it is produced. Exemplary methods of producing acylated amino acids and acylated peptides are known in the art and include acylating an amino acid before inclusion in the peptide or peptide synthesis followed by chemical acylation of the peptide. In some embodiments, the acyl group causes the peptide to have one or more of (i) a prolonged half-life in circulation, (ii) a delayed onset of action, (iii) an extended duration of action, (iv) an improved resistance to proteases, such as DPP-IV, and (v) increased potency at the glucagon superfamily peptide and/or osteocalcin peptide receptors.

As used herein, an "alkylated" amino acid is an amino acid comprising an alkyl group which is non-native to a naturally-occurring amino acid, regardless of the means by which it is produced. Exemplary methods of producing alkylated amino acids and alkylated peptides are known in the art and including alkylating an amino acid before inclusion in the peptide or peptide synthesis followed by chemical alkylation of the peptide. Without being held to any particular theory, it is believed that alkylation of peptides will achieve similar, if not the same, effects as acylation of the peptides, e.g., a prolonged half-life in circulation, a delayed onset of action, an extended duration of action, an improved resistance to proteases, such as DPP-IV, and increased potency at the glucagon superfamily peptide and/or osteocalcin peptide receptors.

As used herein a general reference to a peptide is intended to encompass peptides that have modified amino and carboxy termini For example, an amino acid sequence designating the standard amino acids is intended to encompass standard amino acids at the N- and C-terminus as well as a corresponding hydroxyl acid at the N-terminus and/or a corresponding C-terminal amino acid modified to comprise an amide group in place of the terminal carboxylic acid.

As used herein, the term "pharmaceutically acceptable carrier" includes any of the standard pharmaceutical carriers, such as a phosphate buffered saline solution, water, emulsions such as an oil/water or water/oil, and various types of wetting agents. The term also encompasses any of the agents approved by a regulatory agency of the US Federal government or listed in the US Pharmacopeia for use in animals, including humans.

As used herein the term "pharmaceutically acceptable salt" refers to salts of compounds that retain the biological activity of the parent compound, and which are not biologically or otherwise undesirable. Many of the compounds disclosed herein are capable of forming acid and/or base salts by virtue of the presence of amino and/or carboxyl groups or groups similar thereto.

Pharmaceutically acceptable base addition salts can be prepared from inorganic and organic bases. Salts derived from inorganic bases, include by way of example only, sodium, potassium, lithium, ammonium, calcium and magnesium salts. Salts derived from organic bases include, but are not limited to, salts of primary, secondary and tertiary amines.

Pharmaceutically acceptable acid addition salts may be prepared from inorganic and organic acids. Salts derived from inorganic acids include hydrochloric acid, hydrobromic acid, sulfuric acid, nitric acid, phosphoric acid, and the like. Salts derived from organic acids include acetic acid, propionic acid, glycolic acid, pyruvic acid, oxalic acid, malic acid, malonic acid, succinic acid, maleic acid, fumaric acid, tartaric acid, citric acid, benzoic acid, cinnamic acid, mandelic acid, methanesulfonic acid, ethanesulfonic acid, p-toluene-sulfonic acid, salicylic acid, and the like.

As used herein, the term "treating" includes prophylaxis of the specific disorder or condition, or alleviation of the symptoms associated with a specific disorder or condition and/or preventing or eliminating said symptoms. For example, as used herein the term "treating diabetes" will refer in general to maintaining glucose blood levels near normal levels and may include increasing or decreasing blood glucose levels depending on a given situation.

As used herein an "effective" amount or a "therapeutically effective amount" of a prodrug refers to a nontoxic but sufficient amount of the prodrug to provide the desired effect. For example one desired effect would be the prevention or treatment of hyperglycemia. The amount that is "effective" will vary from subject to subject, depending on the age and general condition of the individual, mode of administration, and the like. Thus, it is not always possible to specify an exact "effective amount." However, an appropriate "effective" amount in any individual case may be determined by one of ordinary skill in the art using routine experimentation.

The term, "parenteral" means not through the alimentary canal but by some other route such as subcutaneous, intramuscular, intraspinal, or intravenous.

The term "identity" as used herein relates to the similarity between two or more sequences. Identity is measured by dividing the number of identical residues by the total number of residues and multiplying the product by 100 to achieve a percentage. Thus, two copies of exactly the same sequence have 100% identity, whereas two sequences that have amino acid deletions, additions, or substitutions relative to one another have a lower degree of identity. Those skilled in the art will recognize that several computer programs, such as those that employ algorithms such as BLAST (Basic Local Alignment Search Tool, Altschul et al. (1993) J. Mol. Biol. 215:403-410) are available for determining sequence identity.

The term "glucagon related peptide" refers to those peptides which have biological activity (as agonists or antagonists) at any one or more of the glucagon, GLP-1, GLP-2, and GIP receptors and comprise an amino acid sequence that shares at least 40% sequence identity (e.g., 45%, 50%, 55%, 60%, 65%, 70%, 75%, 80%, 85%, 90%, 95%) with at least one of native glucagon, native oxyntomodulin, native exendin-4, native GLP-1, native GLP-2, or native GIP. Unless otherwise stated, any reference to an amino acid position in a glucagon related peptide (e.g. for linkage of a prodrug moiety, a conjugate moiety, a hydrophilic polymer, acylation or alkylation) refers to the position relative to the native glucagon amino acid sequence (SEQ ID NO: 701).

The term "glucagon superfamily peptide" refers to a group of peptides related in structure in their N-terminal and C-terminal regions (see, for example, Sherwood et al., Endocrine Reviews 21: 619-670 (2000)). Members of this group include all glucagon related peptides, as well as Growth Hormone Releasing Hormone (GHRH; SEQ ID NO: 719), vasoactive intestinal peptide (VIP; SEQ ID NO: 720), pituitary adenylate cyclase-activating polypeptide 27 (PACAP-27; SEQ ID NO: 721), peptide histidine isoleucine (PHI), peptide histidine methionine (PHM; SEQ ID NO: 722), Secretin (SEQ ID NO: 723), and analogs, derivatives or conjugates with up to 1, 2, 3, 4, 5, 6, 7, 8, 9 or 10 amino acid modifications relative to the native peptide. Such peptides preferably retain the ability to interact (agonist or antagonist) with receptors of the glucagon receptor superfamily. Unless otherwise stated, any reference to an amino acid position in a glucagon superfamily peptide (e.g. for linkage of a prodrug moiety, a conjugate moiety, a hydrophilic polymer, acylation or alkylation) refers to the position relative to the native glucagon amino acid sequence (SEQ ID NO: 701), see FIG. 10 for an alignment of representative glucagon superfamily peptides.

The term "GLP-1 agonist" refers to a compound that stimulates GLP-1 receptor activity, as measured by cAMP production using a validated in vitro model assay, such as that described in Example 13 of published International Application No. WO 2007/056362, published on May, 18, 2007, the disclosure of which is hereby expressly incorporated by reference into the present application.

As used herein the term "native GLP-1" is a generic term that designates GLP-1(7-36)amide (consisting of the sequence of SEQ ID NO: 704), GLP-1(7-37)acid (consisting of the sequence of SEQ ID NO: 703) or a mixture of those two compounds. As used herein, a general reference to "GLP-1" in the absence of any further designation is intended to mean native GLP-1.

As used herein the term "glucagon peptide" is a generic term that designates the natural glucagon peptide of SEQ ID NO: 701 as well as modified derivatives having one or more amino acid modifications relative to the native glucagon sequence, optionally including but not limited to substitutions at amino acid positions 1, 2, 5, 7, 8, 10, 12, 13, 14, 16, 17, 18, 24, 28 and 29. Generally, all references to a particular amino acid position by number (e.g. position 28) refer to the amino acid at that position in native glucagon (SEQ ID NO: 701) or the corresponding amino acid position in any analogs thereof. For example, a reference to "position 28" would mean the corresponding position 27 for a glucagon analog in which the first amino acid of SEQ ID NO: 701 has been deleted. Similarly, a reference to "position 28" would mean the corresponding position 29 for a glucagon analog in which one amino acid has been added before the N-terminus of SEQ ID NO: 701.

As used herein the term "GLP-1 peptide" is a generic term that designates native GLP-1 as well as modified derivatives having one or more amino acid modifications relative to the native GLP-1 sequence.

As used herein an amino acid "modification" refers to a substitution, addition or deletion of an amino acid, and includes substitution with, or addition of, any of the 20 amino acids commonly found in human proteins, as well as unusual or non-naturally occurring amino acids. Commercial sources of unusual amino acids include Sigma-Aldrich (Milwaukee, Wis.), ChemPep Inc. (Miami, Fla.), and Genzyme Pharmaceuticals (Cambridge, Mass.). Unusual amino acids may be purchased from commercial suppliers, synthesized de novo, or chemically modified or derivatized from naturally occurring amino acids. Amino acid modifications include linkage of an amino acid to a conjugate moiety, such as a hydrophilic polymer, acylation, alkylation, and/or other chemical derivatization of an amino acid.

As used herein an amino acid "substitution" refers to the replacement of one amino acid residue by a different amino acid residue.

As used herein, the term "conservative amino acid substitution" is defined herein as exchanges within one of the following five groups:

I. Small aliphatic, nonpolar or slightly polar residues:
Ala, Ser, Thr, Pro, Gly;
II. Polar, negatively charged residues and their amides:
Asp, Asn, Glu, Gln;
III. Polar, positively charged residues:
His, Arg, Lys; Ornithine (Orn)
IV. Large, aliphatic, nonpolar residues:
Met, Leu, Ile, Val, Cys, Norleucine (Nle), homocysteine
V. Large, aromatic residues:
Phe, Tyr, Trp, acetyl phenylalanine As used herein the term "Chimera 2" refers to a glucagon peptide wherein the native glucagon amino acid sequence (SEQ ID NO: 701) comprising the following modifications: Gln at position 17, Ala at position 18, Lys at position 20, Glu at position 21, Ile at position 23, and Ala at position 24, and a C-terminal amide.

As used herein the general term "polyethylene glycol chain" or "PEG chain", refers to mixtures of condensation polymers of ethylene oxide and water, in a branched or straight chain, represented by the general formula $H(OCH_2CH_2)_kOH$, wherein k is at least 9. Absent any further characterization, the term is intended to include polymers of ethylene glycol with an average total molecular weight selected from the range of 500 to 80,000 Daltons. "Polyethylene glycol chain" or "PEG chain" is used in combination with a numeric suffix to indicate the approximate average molecular weight thereof. For example, PEG-5,000 (5 k PEG) refers to polyethylene glycol chain having a total molecular weight average of about 5,000 Daltons.

As used herein the term "pegylated" and like terms refers to a compound that has been modified from its native state by linking a polyethylene glycol chain to the compound. A "pegylated polypeptide" is a polypeptide that has a PEG chain covalently bound to the polypeptide.

As used herein a "linker" is a bond, molecule or group of molecules that binds two separate entities to one another. Linkers may provide for optimal spacing of the two entities or may further supply a labile linkage that allows the two entities to be separated from each other. Labile linkages include photocleavable groups, acid-labile moieties, base-labile moieties and enzyme-cleavable groups.

As used herein a "dimer" is a complex comprising two subunits covalently bound to one another via a linker. The term dimer, when used absent any qualifying language, encompasses both homodimers and heterodimers. A homodimer comprises two identical subunits, whereas a heterodimer comprises two subunits that differ, although the two subunits are substantially similar to one another.

The term "$C_1$-$C_n$ alkyl" wherein n can be from 1 through 6, as used herein, represents a branched or linear alkyl group having from one to the specified number of carbon atoms. Typical $C_1$-$C_6$ alkyl groups include, but are not limited to, methyl, ethyl, n-propyl, iso-propyl, butyl, iso-butyl, sec-butyl, tert-butyl, pentyl, hexyl and the like.

The terms "$C_2$-$C_n$ alkenyl" wherein n can be from 2 through 6, as used herein, represents an olefinically unsaturated branched or linear group having from 2 to the specified number of carbon atoms and at least one double bond. Examples of such groups include, but are not limited to, 1-propenyl, 2-propenyl (—$CH_2$—CH=$CH_2$), 1,3-butadienyl, (—CH=CHCH=$CH_2$), 1-butenyl (—CH=CHCH$_2$CH$_3$), hexenyl, pentenyl, and the like.

The term "$C_2$-$C_n$ alkynyl" wherein n can be from 2 to 6, refers to an unsaturated branched or linear group having from 2 to n carbon atoms and at least one triple bond. Examples of such groups include, but are not limited to, 1-propynyl, 2-propynyl, 1-butynyl, 2-butynyl, 1-pentynyl, and the like.

As used herein the term "aryl" refers to a mono- or bicyclic carbocyclic ring system having one or two aromatic rings including, but not limited to, phenyl, naphthyl, tetrahydronaphthyl, indanyl, indenyl, and the like. The size of the aryl ring and the presence of substituents or linking groups are indicated by designating the number of carbons present. For example, the term "($C_1$-$C_3$ alkyl)($C_6$-$C_{10}$ aryl)" refers to a 6 to 10 membered aryl that is attached to a parent moiety via a one to three membered alkyl chain.

The term "heteroaryl" as used herein refers to a mono- or bicyclic ring system containing one or two aromatic rings and containing at least one nitrogen, oxygen, or sulfur atom in an aromatic ring. The size of the heteroaryl ring and the presence of substituents or linking groups are indicated by designating the number of carbons present. For example, the term "($C_1$-$C_n$ alkyl)($C_5$-$C_6$ heteroaryl)" refers to a 5 or 6 membered heteroaryl that is attached to a parent moiety via a one to "n" membered alkyl chain.

As used herein, the term "heteroalkyl" refers to a linear or branched hydrocarbon containing the indicated number of carbon atoms and at least one heteroatom in the backbone of the structure. Suitable heteroatoms for purposes herein include but are not limited to N, S, and O.

As used herein, the term "halo" refers to one or more members of the group consisting of fluorine, chlorine, bromine, and iodine.

As used herein the term "charged amino acid" refers to an amino acid that comprises a side chain that is negatively charged (i.e., deprotonated) or positively charged (i.e., protonated) in aqueous solution at physiological pH. For example negatively charged amino acids include aspartic acid, glutamic acid, cysteic acid, homocysteic acid, and homoglutamic acid, whereas positively charged amino acids include arginine, lysine and histidine. Charged amino acids include the charged amino acids among the 20 amino acids commonly found in human proteins, as well as atypical or non-naturally occurring amino acids.

As used herein the term "acidic amino acid" refers to an amino acid that comprises a second acidic moiety (i.e. other than the α-carboyxl group that all amino acids possess), including for example, a carboxylic acid or sulfonic acid group.

As used herein the term "patient" without further designation is intended to encompass any warm blooded vertebrate domesticated animal (including for example, but not limited to livestock, horses, cats, dogs and other pets), mammals, and humans.

Embodiments

The present disclosure describes the formulation of prodrug derivatives of bioactive polypeptides useful for treating a disease, e.g., diabetes, obesity. More particularly, the prodrugs disclosed herein are formulated to enhance the half life of the parent bioactive peptide or protein, while allowing for subsequent activation of the prodrug via a non-enzymatic degradation mechanism. The ideal prodrug should be soluble in water at physiological conditions (for example, a pH of 7.2 and 37° C.), and it should be stable in the powder form for long term storage. It should also be immunologically silent and exhibit a low activity relative to the parent drug. In some embodiments, the prodrug will exhibit no more than 10% of the activity of the parent drug. In some embodiments the prodrug exhibits less than about 10%, less than about 5%, about 1%, or less than about 1% activity relative to the parent drug. Furthermore, the prodrug, when injected in the body, should be quantitatively converted to the active drug within a defined period of time. As disclosed herein, applicants have provided a general technique for producing prodrugs of a known bioactive polypeptide selected from the group consisting of glucagon superfamily peptides, including glucagon-related peptides, and osteocalcin, and analogs, derivatives and conjugates of such polypeptides, that meet each of these objectives.

More particularly, a chemoreversible prodrug is provided comprising the sequence of a glucagon superfamily peptide, including for example a glucagon related peptide, or osteocalcin, or an analog, derivative or conjugate thereof, modified to have a dipeptide prodrug element covalently bound to the peptide via an amide linkage. Covalent attachment of the dipeptide prodrug element to an active site of the glucagon superfamily peptide inhibits the activity of the polypeptide until cleavage of the dipeptide prodrug element. In some embodiments a prodrug is provided having a "non-enzymatic activation half life" ($t_{1/2}$) between about 1 to about 720 hrs under physiological conditions. Physiological conditions as disclosed herein are intended to include a temperature of about 35 to 40° C. and a pH of about 7.0 to about 7.4 and more typically include a pH of 7.2 to 7.4 and a temperature of 36 to 38° C.

Advantageously, the rate of cleavage, and thus activation of the prodrug, depends on the structure and stereochemistry of the dipeptide prodrug element. The prodrugs disclosed herein ultimately are chemically converted to structures that are recognized by the native receptor of the drug, wherein the speed of this chemical conversion determines the time of onset and duration of in vivo biological action. The molecular design disclosed in this application relies upon an intramolecular chemical reaction that is not dependent upon additional chemical additives, or enzymes. The speed of conversion is controlled by the chemical nature of the dipeptide substituent and its cleavage under physiological conditions. Since physiological pH and temperature are tightly regulated within a highly defined range, the speed of conversion from prodrug to drug will exhibit high intra- and interpatient reproducibility.

As disclosed herein prodrugs are provided which have extended half lives by virtue of being in a prodrug form for at least about 1 hour, and, in some embodiments, greater than about 20 hours. In some embodiments the half life of the prodrugs is about 1, 6, 8, 12, 20, 24, 48 or 72 hours. In some embodiments the half life of the prodrugs is about 100 hours or greater including half lives of up to about 168, 336, 504, 672 or 720 hours, and are converted to the active form at physiological conditions through a non-enzymatic reaction driven by inherent chemical instability. In some embodiments the non-enzymatic activation $t_{1/2}$ time of the prodrug is between 1-100 hrs, and more typically between 12 and 72 hours, for example, between 12 and 48 hours and between 48 and 72 hours, and in some embodiments the $t_{1/2}$ is between 24-48 hrs as measured by incubating the prodrug in a phosphate buffer solution (e.g., PBS) at 37° C. and pH of 7.2. In another embodiment the non-enzymatic activation $t_{1/2}$ time of the prodrug is between 1 and 6 hours, for example, about 1 hour, about 2 hours, about 3 hours, about 4 hours, about 5 hours, or about 6 hours. In another embodiment the non-enzymatic activation $t_{1/2}$ time of the prodrug is between 6 and 24 hours. The half lives of the various prodrugs are calculated by using the formula $t_{1/2}=0.693/k$, where 'k' is the first order rate constant for the degradation of the prodrug. In some embodiments, activation of the prodrug occurs after cleavage of an amide bond linked dipeptide, and formation of a diketopiperazine or diketomorpholine, and release of the active polypeptide drug. Specific dipeptides composed of natural, non-coding and/or synthetic amino acids have been identified that facilitate intramolecular decomposition under physiological conditions to release the active polypeptides.

In accordance with some embodiments a prodrug of a glucagon superfamily peptide, or osteocalcin, or an analog, derivative or conjugate thereof, is provided comprising the structure A-B-Q. In this embodiment, Q is the peptide, A is an amino acid or a hydroxy acid and B is an N-alkylated amino acid. In some embodiments the glucagon superfamily peptide is a glucagon related peptide. A and B together represent the dipeptide prodrug element that is linked to Q through formation of an amide bond between A-B and an amine of Q. In some embodiments at least one of A, B, or the amino acid of Q to which A-B is linked, is a non-coded amino acid. Furthermore, in some embodiments the dipeptide prodrug element is selected wherein chemical cleavage of A-B from Q is at least about 90% complete within about 1 to about 720 hours in PBS under physiological conditions. In a further embodiment the amino acids of the dipeptide are selected wherein the cleavage half-life of A-B from Q in PBS under physiological conditions, is not more than two to five fold the cleavage half-life of A-B from Q in a solution comprising a DPP-IV protease (including for example, human serum).

In accordance with some embodiments an aliphatic amino group of Q (e.g., a primary amine), including for example the N-terminal amine or the amino group of an amino acid side chain, is modified by the covalent linkage of the dipeptide prodrug element via an amide bond. In some embodiments the dipeptide prodrug element is linked to a side chain amino group of an amino acid present in Q, either directly or through a linking moiety. In some embodiments the linking moiety comprises an amine bearing acyl group or alkyl group. In some embodiments a glucagon superfamily peptide, e.g., glucagon related peptide, is provided comprising an acyl group or alkyl group covalently linked to the amino acid at position 10 or 20 of the glucagon superfamily peptide, wherein the acyl group or alkyl group further comprises a dipeptide prodrug element linked to the acyl group or alkyl group via an amide bond. For example, the embodiment contemplates that the prodrug is linked to an amino group of Q either directly or through a linking group, and an acyl or alkyl group is linked to the prodrug either directly or through a linking moiety.

In some embodiments the dipeptide prodrug element is linked directly to the amino acid side chain, wherein the amino acid has the general structure:

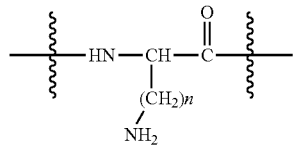

wherein n is an integer of 1-4.

Alternatively, the dipeptide prodrug element can be linked to an amino substituent present on an aryl ring of an aromatic amino acid, including for example an aromatic amino acid selected from the group consisting of amino-Phe, amino-napthyl alanine, amino tryptophan, amino-phenyl-glycine, amino-homo-Phe, and amino tyrosine. In some embodiments the dipeptide prodrug element is linked to the aromatic amino group of an amino acid having the general structure:

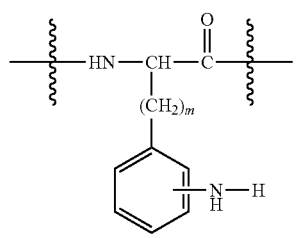

wherein m is an integer from 0 to 3. In some embodiments the dipeptide prodrug element is linked to the 4-amino group of an amino acid having the general structure:

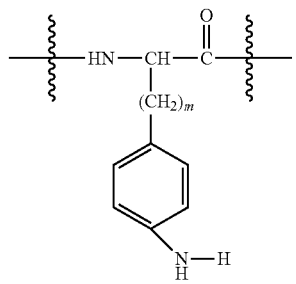

wherein m is an integer from 0 to 3. In some embodiments the dipeptide prodrug element is linked to the side chain amino group of a lysine amino acid or the aromatic amino group of a 4-aminophenylalanine (substituted for a native phenylalanine or tyrosine residue of the bioactive peptide). In some embodiments the dipeptide prodrug element is linked to a primary amine present on an internal amino acid of a glucagon superfamily peptide, including a glucagon-related peptide, or osteocalcin, or an analog, derivatives or conjugate thereof.

In some embodiments the dipeptide prodrug element has the general structure A-B, wherein A is an amino acid or a hydroxyl acid and B is an N-alkylated amino acid that will be bound through an amide bond to a primary amino group of such a peptide to produce the corresponding prodrug of the peptide. In some embodiments the glucagon superfamily peptide is a glucagon related peptide. In some embodiments A and B are selected so that when the A-B dipeptide is bound to a primary amine of such a peptide through an amide bond, chemical cleavage of A-B from the peptide is at least about 90% complete within about 1 to about 720 hours in PBS under physiological conditions. In some embodiments A and/or B are amino acids in the D stereoisomer configuration. In some exemplary embodiments, A is an amino acid in the D stereoisomer configuration and B is an amino acid in the L stereoisomer configuration. In some exemplary embodiments, A is an amino acid in the L stereoisomer configuration and B is an amino acid in the D stereoisomer configuration. In some exemplary embodiments, A is an amino acid in the D stereoisomer configuration and B is an amino acid in the D stereoisomer configuration.

In accordance with some embodiments the dipeptide prodrug element can be further modified to comprise a hydrophilic moiety. In some embodiments the hydrophilic moiety is a polyethylene glycol chain. In accordance with some embodiments a polyethylene glycol chain of 40 k or higher is covalently bound to the side chain of the A or B amino acid of the dipeptide prodrug element. In another embodiment the dipeptide prodrug element is additionally or alternatively acylated or alkylated with a fatty acid or bile acid, or salt thereof, e.g. a C4 to C30 fatty acid, a C8 to C24 fatty acid, cholic acid, a C4 to C30 alkyl, a C8 to C24 alkyl, or an alkyl comprising a steroid moiety of a bile acid. The 'A' amino acid of the dipeptide prodrug element can include, for example, d-lysine covalently bound to an acyl or alkyl group through its side chain amino group, or d-cysteine covalently bound to a PEG molecule through its side chain sulfhydryl group. The dipeptide prodrug element can be directly bound to the hydrophilic moiety, acyl group, or alkyl group, or bound to the hydrophilic moiety, acyl group, or alkyl group through a spacer, as described herein. Alternatively, the dipeptide prodrug element can be linked to a depot protein such as dextran or a large PEG molecule (greater or equal to 80,000 daltons) that serves to sequester the prodrug at an injection site until cleavage of the dipeptide releases the active bioactive peptide. Further modifications for dipeptide prodrugs are described below in the section concerning glucagon related peptides.

The dipeptide prodrug element is designed to cleave based upon an intramolecular chemical reaction that is not dependent upon additional chemical additives, or enzymes. More particularly, in some embodiments the dipeptide structure is selected to resist cleavage by peptidases present in mammalian sera, including for example dipeptidyl peptidase IV (DPP-IV). Accordingly, in some embodiments the rate of cleavage of the dipeptide prodrug element from the bioactive peptide is not substantially enhanced (e.g., greater than 2×) when the reaction is conducted using physiological conditions in the presence of serum proteases relative to conducting the reaction in the absence of the proteases. Thus the cleavage half-life of A-B from the bioactive peptide in PBS under physiological conditions, is not more than two, three, four or five fold the cleavage half-life of A-B from the bioactive protein in a solution comprising a DPP-IV protease. In some embodiments the solution comprising a DPP-IV protease is serum, more particularly mammalian serum, including human serum.

In accordance with some embodiments A or B of the dipeptide prodrug element, or the amino acid of the glucagon superfamily peptide to which A-B is linked is a non-coded amino acid. In some embodiments amino acid "B" is N-alkylated but is not proline. In some embodiments the N-alkylated group of amino acid B is a $C_1$-$C_{18}$ alkyl, and in some embodiments is $C_1$-$C_6$ alkyl.

In accordance with some embodiments a prodrug derivative of a glucagon superfamily peptide, comprising a dipeptide prodrug element disclosed herein, can be co-administered with a protease inhibitor, including a specific DPP-IV inhibitor (e.g., Januvia®, Merck & Co, Inc), as a means of delaying activation of the prodrug. In this embodiment the amino acids of the prodrug element are selected so the dipeptide is an acceptable substrate for DPP-IV cleavage. In some embodiments the glucagon superfamily peptide is a glucagon related peptide. The protease inhibitor can be administered in a separate composition or the prodrug and protease inhibitor can be formulated as a single composition. When administered as separate compositions, the protease inhibitor is typically administered within 1-5 hours, 1-2 hours, 30 minutes, or 10 minutes of administration of the prodrug. In some embodiments the two separate compositions are administered immediately one after the other.

In some embodiments the dipeptide prodrug element has the general structure of Formula I:

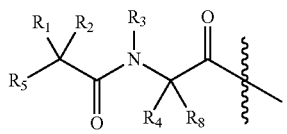

wherein $R_1$, $R_2$, $R_4$ and $R_8$ are independently selected from the group consisting of H, $C_1$-$C_{18}$ alkyl, $C_2$-$C_{18}$ alkenyl, ($C_1$-$C_{18}$ alkyl)OH, ($C_1$-$C_{18}$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2^+$)NH$_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl)$R_7$, ($C_1$-$C_4$ alkyl)($C_3$-$C_9$ heteroaryl), and $C_1$-$C_{12}$ alkyl (A)($W_1$)$C_1$-$C_{12}$ alkyl, wherein $W_1$ is a heteroatom selected from the group consisting of N, S and O, or $R_1$ and $R_2$ together with the atoms to which they are attached form a $C_3$-$C_{12}$ cycloalkyl or aryl; or $R_4$ and $R_8$ together with the atoms to which they are attached form a $C_3$-$C_6$ cycloalkyl;

$R_3$ is selected from the group consisting of $C_1$-$C_{18}$ alkyl, ($C_1$-$C_{18}$ alkyl)OH, ($C_1$-$C_{18}$ alkyl)NH$_2$, ($C_1$-$C_{18}$ alkyl)SH, ($C_0$-$C_4$ alkyl)($C_3$-$C_6$)cycloalkyl, ($C_0$-$C_4$ alkyl)($C_2$-$C_5$ heterocyclic), ($C_0$-$C_4$ alkyl)($C_6$-$C_{10}$ aryl)$R_7$, and ($C_1$-$C_4$ alkyl)($C_3$-$C_9$ heteroaryl) or $R_4$ and $R_3$ together with the atoms to which they are attached form a 4, 5 or 6 member heterocyclic ring;

$R_5$ is NHR$_6$ or OH;

$R_6$ is H, $C_1$-$C_8$ alkyl or $R_6$ and $R_2$ together with the atoms to which they are attached form a 4, 5 or 6 member heterocyclic ring; and $R_7$ is selected from the group consisting of H and OH.

It is apparent to one skilled in the art that when $W_1$ is N, under physiological conditions the nitrogen atom is linked to H.

In other embodiments the dipeptide prodrug element has the general structure of Formula I:

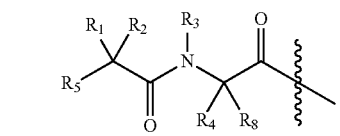

wherein $R_1$, $R_2$, $R_4$ and $R_8$ are independently selected from the group consisting of H, $C_1$-$C_{18}$ alkyl, $C_2$-$C_{18}$ alkenyl, ($C_1$-$C_{18}$ alkyl)OH, ($C_1$-$C_{18}$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2^+$)NH$_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl)$R_7$, ($C_1$-$C_4$ alkyl)($C_3$-$C_9$ heteroaryl), and $C_1$-$C_{12}$ alkyl ($W_1$)$C_1$-$C_{12}$ alkyl, wherein $W_1$ is a heteroatom selected from the group consisting of N, S and O, or $R_1$ and $R_2$ together with the atoms to which they are attached form a $C_3$-$C_{12}$ cycloalkyl; or $R_4$ and $R_8$ together with the atoms to which they are attached form a $C_3$-$C_6$ cycloalkyl;

$R_3$ is selected from the group consisting of $C_1$-$C_{18}$ alkyl, ($C_1$-$C_{18}$ alkyl)OH, ($C_1$-$C_{18}$ alkyl)NH$_2$, ($C_1$-$C_8$ alkyl)SH, ($C_0$-$C_4$ alkyl)($C_3$-$C_6$)cyclo alkyl, ($C_0$-$C_4$ alkyl)($C_2$-$C_5$ heterocyclic), ($C_0$-$C_4$ alkyl)($C_6$-$C_{10}$ aryl)$R_7$, and ($C_1$-$C_4$ alkyl)($C_3$-$C_9$ heteroaryl) or $R_4$ and $R_3$ together with the atoms to which they are attached form a 4, 5 or 6 member heterocyclic ring;

$R_5$ is NHR$_6$ or OH;

$R_6$ is H, $C_1$-$C_8$ alkyl or $R_6$ and $R_1$ together with the atoms to which they are attached form a 4, 5 or 6 member heterocyclic ring; and $R_7$ is selected from the group consisting of hydrogen, $C_1$-$C_{18}$ alkyl, $C_2$-$C_{18}$ alkenyl, ($C_0$-$C_4$ alkyl)CONH$_2$, ($C_0$-$C_4$ alkyl)COOH, ($C_0$-$C_4$ alkyl)NH$_2$, ($C_0$-$C_4$ alkyl)OH, and halo.

In some embodiments $R_8$ is H and $R_5$ is NHR$_6$.

In some embodiments the dipeptide prodrug element has the structure of Formula I, wherein $R_1$ and $R_8$ are independently H or $C_1$-$C_8$ alkyl;

$R_2$ and $R_4$ are independently selected from the group consisting of H, $C_1$-$C_8$ alkyl, $C_2$-$C_8$ alkenyl, ($C_1$-$C_4$ alkyl)OH, ($C_1$-$C_4$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2$+)NH$_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl)$R_7$, and CH$_2$ ($C_3$-$C_9$ heteroaryl), or $R_1$ and $R_2$ together with the atoms to which they are attached form a $C_3$-$C_{12}$ cycloalkyl or aryl;

$R_5$ is NHR$_6$; and $R_6$ is H or $C_1$-$C_8$ alkyl.

In other embodiments the dipeptide prodrug element has the structure of Formula I, wherein $R_1$ and $R_8$ are independently H or $C_1$-$C_8$ alkyl;

$R_2$ and $R_4$ are independently selected from the group consisting of H, $C_1$-$C_8$ alkyl, $C_2$-$C_8$ alkenyl, ($C_1$-$C_4$ alkyl)OH, ($C_1$-$C_4$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2$+)NH$_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl)$R_7$, and CH$_2$($C_3$-$C_9$ heteroaryl), or $R_1$ and $R_2$ together with the atoms to which they are attached form a $C_3$-$C_{12}$ cycloalkyl;

$R_3$ is $C_1$-$C_{18}$ alkyl;

$R_5$ is NHR$_6$;

$R_6$ is H or $C_1$-$C_8$ alkyl; and $R_7$ is selected from the group consisting of hydrogen, $C_1$-$C_{18}$ alkyl, $C_2$-$C_{18}$ alkenyl, ($C_0$-$C_4$ alkyl)CONH$_2$, ($C_0$-$C_4$ alkyl)COOH, ($C_0$-$C_4$ alkyl)NH$_2$, ($C_0$-$C_4$ alkyl)OH, and halo.

The half life of the prodrug formed in accordance with the present disclosure is determined by the substituents of the dipeptide prodrug element, its location, and the amino acid to which it is attached. For example, the prodrug may comprise a glucagon superfamily peptide wherein the dipeptide prodrug element is linked through the alpha amino group of the N-terminal amino acid of the glucagon superfamily protein. In this embodiment prodrugs having a $t_{1/2}$ of, e.g., about 1 hour comprise a dipeptide prodrug element with the structure:

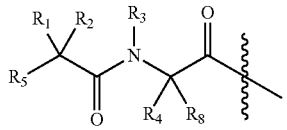

wherein $R_1$ and $R_2$ are independently $C_1$-$C_{18}$ alkyl or aryl; or $R_1$ and $R_2$ are linked through —(CH$_2$)$_p$, wherein p is 2-9;

$R_3$ is $C_1$-$C_{18}$ alkyl;

$R_4$ and $R_8$ are each hydrogen; and $R_5$ is an amine.

In other embodiments, prodrugs having a $t_{1/2}$ of, e.g., about 1 hour comprise a dipeptide prodrug element with the structure:

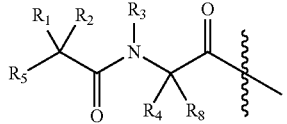

wherein $R_1$ and $R_2$ are independently $C_1$-$C_{18}$ alkyl or ($C_0$-$C_4$ alkyl)($C_6$-$C_{10}$ aryl)$R_7$; or $R_1$ and $R_2$ are linked through —(CH$_2$)$_p$, wherein p is 2-9;

$R_3$ is $C_1$-$C_{18}$ alkyl;

$R_4$ and $R_8$ are each hydrogen;

$R_5$ is NH$_2$; and $R_7$ is selected from the group consisting of hydrogen, $C_1$-$C_{18}$ alkyl, $C_2$-$C_{18}$ alkenyl, ($C_0$-$C_4$ alkyl)CONH$_2$, ($C_0$-$C_4$ alkyl)COOH, ($C_0$-$C_4$ alkyl)NH$_2$, ($C_0$-$C_4$ alkyl)OH, and halo.

Furthermore, prodrugs having the dipeptide prodrug element linked to the N-terminal alpha amino acid of the glucagon superfamily peptide and having a $t_{1/2}$, e.g., between about 6 to about 24 hours comprise a dipeptide prodrug element with the structure:

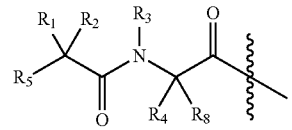

wherein $R_1$ and $R_2$ are independently selected from the group consisting of hydrogen, $C_1$-$C_{18}$ alkyl and aryl, or $R_1$ and $R_2$ are linked through (CH$_2$)$_p$, wherein p is 2-9;

$R_3$ is $C_1$-$C_{18}$ alkyl or $R_3$ and $R_4$ together with the atoms to which they are attached form a 4-12 heterocyclic ring;

$R_4$ and $R_8$ are independently selected from the group consisting of hydrogen, $C_1$-$C_8$ alkyl and aryl; and $R_5$ is an amine;

with the proviso that both $R_1$ and $R_2$ are not hydrogen and provided that one of $R_4$ or $R_8$ is hydrogen.

In some embodiments, prodrugs having the dipeptide prodrug element linked to the N-terminal alpha amino acid of the glucagon superfamily peptide and having a $t_{1/2}$, e.g., between about 12 to about 72 hours, or in some embodiments between about 12 to about 48 hours, comprise a dipeptide prodrug element with the structure:

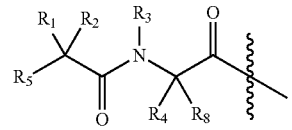

I wherein $R_1$ and $R_2$ are independently selected from the group consisting of hydrogen, $C_1$-$C_{18}$ alkyl, ($C_1$-$C_{18}$ alkyl)OH, ($C_1$-$C_4$ alkyl)NH$_2$, and ($C_0$-$C_4$ alkyl)($C_6$-$C_{10}$ aryl)$R_7$, or $R_1$ and $R_2$ are linked through (CH$_2$)$_p$, wherein p is 2-9;

$R_3$ is $C_1$-$C_{18}$ alkyl or $R_3$ and $R_4$ together with the atoms to which they are attached form a 4-12 heterocyclic ring;

$R_4$ and $R_8$ are independently selected from the group consisting of hydrogen, $C_1$-$C_8$ alkyl and ($C_0$-$C_4$ alkyl)($C_6$-$C_{10}$ aryl)$R_7$;

$R_5$ is NH$_2$; and $R_7$ is selected from the group consisting of H, $C_1$-$C_{18}$ alkyl, $C_2$-$C_{18}$ alkenyl, ($C_0$-$C_4$ alkyl)CONH$_2$, ($C_0$-$C_4$ alkyl)COOH, ($C_0$-$C_4$ alkyl)NH$_2$, ($C_0$-$C_4$ alkyl)OH, and halo;

with the proviso that both $R_1$ and $R_2$ are not hydrogen and provided that at least one of $R_4$ or $R_8$ is hydrogen.

In some embodiments, prodrugs having the dipeptide prodrug element linked to the N-terminal amino acid of the glucagon superfamily peptide and having a $t_{1/2}$, e.g., between about 12 to about 72 hours, or in some embodiments between about 12 to about 48 hours, comprise a dipeptide prodrug element with the structure:

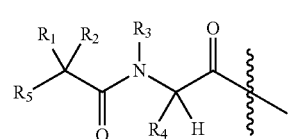

I wherein $R_1$ and $R_2$ are independently selected from the group consisting of hydrogen, $C_1$-$C_8$ alkyl and ($C_1$-$C_4$ alkyl)NH$_2$, or $R_1$ and $R_2$ are linked through (CH$_2$)$_p$, wherein p is 2-9;

$R_3$ is $C_1$-$C_8$ alkyl or $R_3$ and $R_4$ together with the atoms to which they are attached form a 4-6 heterocyclic ring;

$R_4$ is selected from the group consisting of hydrogen and $C_1$-$C_8$ alkyl; and $R_5$ is $NH_2$;

with the proviso that both $R_1$ and $R_2$ are not hydrogen.

In other embodiments, prodrugs having the dipeptide prodrug element linked to the N-terminal amino acid of the glucagon superfamily peptide and having a $t_{1/2}$, e.g., between about 12 to about 72 hours, or in some embodiments between about 12 to about 48 hours, comprise a dipeptide prodrug element with the structure:

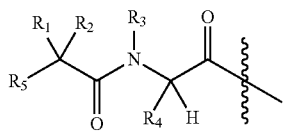

I wherein $R_1$ and $R_2$ are independently selected from the group consisting of hydrogen, $C_1$-$C_8$ alkyl and ($C_1$-$C_4$ alkyl)$NH_2$;

$R_3$ is $C_1$-$C_6$ alkyl;

$R_4$ is hydrogen; and $R_5$ is $NH_2$;

with the proviso that both $R_1$ and $R_2$ are not hydrogen.

In some embodiments, prodrugs having the dipeptide prodrug element linked to the N-terminal amino acid of the glucagon superfamily peptide and having a $t_{1/2}$, e.g., between about 12 to about 72 hours, or in some embodiments between about 12 to about 48 hours, comprise a dipeptide prodrug element with the structure:

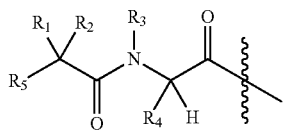

I wherein $R_1$ and $R_2$ are independently selected from the group consisting of hydrogen and $C_1$-$C_8$ alkyl, ($C_1$-$C_4$ alkyl)$NH_2$, or $R_1$ and $R_2$ are linked through $(CH_2)_p$, wherein p is 2-9;

$R_3$ is $C_1$-$C_8$ alkyl;

$R_4$ is ($C_0$-$C_4$ alkyl)($C_6$-$C_{10}$ aryl)$R_7$;

$R_5$ is $NH_2$; and $R_7$ is selected from the group consisting of hydrogen, $C_1$-$C_8$ alkyl and ($C_0$-$C_4$ alkyl)OH;

with the proviso that both $R_1$ and $R_2$ are not hydrogen.

In some embodiments the glucagon superfamily peptide is a glucagon related peptide. In any of these embodiments, the glucagon superfamily peptide is any of SEQ ID NOs: 1-684, 701-731, 801-919, 1001-1262, 1301-1371, 1401-1518, 1701-1776, and 1801-1908.

In addition a prodrug having the dipeptide prodrug element linked to the N-terminal alpha amino acid of the glucagon superfamily peptide and having a $t_{1/2}$, e.g., of about 72 to about 168 hours is provided wherein the dipeptide prodrug element has the structure:

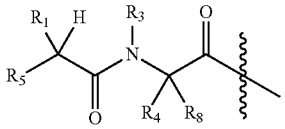

wherein $R_1$ is selected from the group consisting of hydrogen, $C_1$-$C_8$ alkyl and aryl;

$R_3$ is $C_1$-$C_{18}$ alkyl;

$R_4$ and $R_8$ are each hydrogen; and $R_5$ is an amine or N-substituted amine or a hydroxyl;

with the proviso that, if $R_1$ is alkyl or aryl, then $R_1$ and $R_5$ together with the atoms to which they are attached form a 4-11 heterocyclic ring.

In some embodiments, the dipeptide prodrug element has the structure:

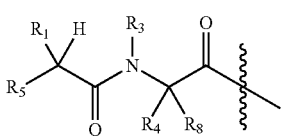

I wherein $R_1$ is selected from the group consisting of hydrogen, $C_1$-$C_8$ alkyl and ($C_0$-$C_4$ alkyl) ($C_6$-$C_{10}$ aryl)$R_7$;

$R_3$ is $C_1$-$C_{18}$ alkyl;

$R_4$ and $R_8$ are each hydrogen;

$R_5$ is $NHR_6$ or OH;

$R_6$ is H, $C_1$-$C_8$ alkyl, or $R_6$ and $R_1$ together with the atoms to which they are attached form a 4, 5 or 6 member heterocyclic ring; and $R_7$ is selected from the group consisting of hydrogen, $C_1$-$C_{18}$ alkyl, $C_2$-$C_{18}$ alkenyl, ($C_0$-$C_4$ alkyl)$CONH_2$, ($C_0$-$C_4$ alkyl)COOH, ($C_0$-$C_4$ alkyl)$NH_2$, ($C_0$-$C_4$ alkyl)OH, and halo;

with the proviso that, if $R_1$ is alkyl or ($C_0$-$C_4$ alkyl)($C_6$-$C_{10}$ aryl)$R_7$, then $R_1$ and $R_5$ together with the atoms to which they are attached form a 4-11 heterocyclic ring. In some embodiments the glucagon superfamily peptide is a glucagon related peptide.

In some embodiments the dipeptide prodrug element is linked to a side chain amine of an internal amino acid of the glucagon superfamily peptide. In this embodiment prodrugs having a $t_{1/2}$, e.g., of about 1 hour have the structure:

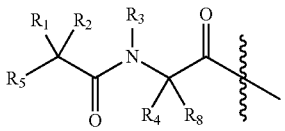

wherein $R_1$ and $R_2$ are independently $C_1$-$C_8$ alkyl or aryl; or $R_1$ and $R_2$ are linked through $(CH_2)_p$, wherein p is 2-9;

$R_3$ is $C_1$-$C_{18}$ alkyl;

$R_4$ and $R_8$ are each hydrogen; and $R_5$ is an amine.

In some embodiments, prodrugs having a $t_{1/2}$, e.g., of about 1 hour have the structure:

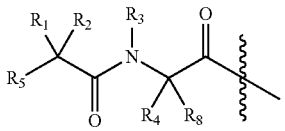

wherein $R_1$ and $R_2$ are independently $C_1$-$C_8$ alkyl or ($C_0$-$C_4$ alkyl)($C_6$-$C_{10}$ aryl)$R_7$; or $R_1$ and $R_2$ are linked through —$(CH_2)_p$—, wherein p is 2-9;

$R_3$ is $C_1$-$C_{18}$ alkyl;

$R_4$ and $R_8$ are each hydrogen;

$R_5$ is $NH_2$; and $R_7$ is selected from the group consisting of hydrogen, $C_1$-$C_{18}$ alkyl, $C_2$-$C_{18}$ alkenyl, ($C_0$-$C_4$ alkyl)$CONH_2$, ($C_0$-$C_4$ alkyl)COOH, ($C_0$-$C_4$ alkyl)$NH_2$, ($C_0$-$C_4$ alkyl)OH, and halo.

Furthermore, prodrugs having a $t_{1/2}$, e.g., between about 6 to about 24 hours and having the dipeptide prodrug element linked to a internal amino acid side chain comprise a dipeptide prodrug element with the structure:

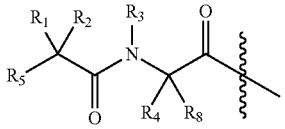

wherein $R_1$ and $R_2$ are independently selected from the group consisting of hydrogen, $C_1$-$C_8$ alkyl and aryl, or $R_1$ and $R_2$ are linked through —$(CH_2)_p$—, wherein p is 2-9;

$R_3$ is $C_1$-$C_{18}$ alkyl or $R_3$ and $R_4$ together with the atoms to which they are attached form a 4-12 heterocyclic ring;

$R_4$ and $R_8$ are independently $C_1$-$C_{18}$ alkyl or aryl; and $R_5$ is an amine or N-substituted amine;

with the proviso that both $R_1$ and $R_2$ are not hydrogen and provided that one of $R_4$ or $R_8$ is hydrogen.

In some embodiments, prodrugs having a $t_{1/2}$, e.g., between about 12 to about 72 hours, or in some embodiments between about 12 to about 48 hours, and having the dipeptide prodrug element linked to a internal amino acid side chain comprise a dipeptide prodrug element with the structure:

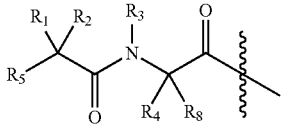

wherein $R_1$ and $R_2$ are independently selected from the group consisting of hydrogen, $C_1$-$C_8$ alkyl, and ($C_0$-$C_4$ alkyl)($C_6$-$C_{10}$ aryl)$R_7$, or $R_1$ and $R_2$ are linked through —$(CH_2)_p$—, wherein p is 2-9;

$R_3$ is $C_1$-$C_{18}$ alkyl or $R_3$ and $R_4$ together with the atoms to which they are attached form a 4-12 heterocyclic ring;

$R_4$ and $R_8$ are independently hydrogen, $C_1$-$C_{18}$ alkyl or ($C_0$-$C_4$ alkyl)($C_6$-$C_{10}$ aryl)$R_7$;

$R_5$ is $NHR_6$;

$R_6$ is H or $C_1$-$C_8$ alkyl, or $R_6$ and $R_2$ together with the atoms to which they are attached form a 4, 5 or 6 member heterocyclic ring; and $R_7$ is selected from the group consisting of hydrogen, $C_1$-$C_{18}$ alkyl, $C_2$-$C_{18}$ alkenyl, ($C_0$-$C_4$ alkyl)$CONH_2$, ($C_0$-$C_4$ alkyl)COOH, ($C_0$-$C_4$ alkyl)$NH_2$, ($C_0$-$C_4$ alkyl)OH, and halo;

with the proviso that both $R_1$ and $R_2$ are not hydrogen and provided that at least one of $R_4$ or $R_8$ is hydrogen. In some embodiments the glucagon superfamily peptide is a glucagon related peptide.

In addition a prodrug having a $t_{1/2}$, e.g., of about 72 to about 168 hours and having the dipeptide prodrug element linked to a internal amino acid side chain of the glucagon superfamily peptide is provided wherein the dipeptide prodrug element has the structure:

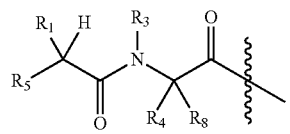

wherein $R_1$ and $R_2$ are independently selected from the group consisting of hydrogen, $C_1$-$C_{18}$ alkyl and aryl;

$R_3$ is $C_1$-$C_{18}$ alkyl;

$R_4$ and $R_8$ are each hydrogen; and $R_5$ is an amine or N-substituted amine or a hydroxyl;

with the proviso that, if $R_1$ and $R_2$ are both independently an alkyl or aryl, either $R_1$ or $R_2$ is linked through $(CH_2)_p$ to $R_5$, wherein p is 2-9.

In some embodiments, a prodrug having a $t_{1/2}$, e.g., of about 72 to about 168 hours and having the dipeptide prodrug element linked to a internal amino acid side chain of the glucagon superfamily peptide is provided wherein the dipeptide prodrug element has the structure:

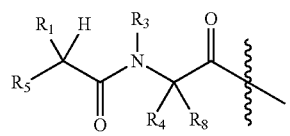

wherein $R_1$ is selected from the group consisting of hydrogen, $C_1$-$C_{18}$ alkyl and ($C_0$-$C_4$ alkyl)($C_6$-$C_{10}$ aryl)$R_7$;

$R_3$ is $C_1$-$C_{18}$ alkyl;

$R_4$ and $R_8$ are each hydrogen;

$R_5$ is $NHR_6$ or OH;

$R_6$ is H or $C_1$-$C_8$ alkyl, or $R_6$ and $R_1$ together with the atoms to which they are attached form a 4, 5 or 6 member heterocyclic ring; and $R_7$ is selected from the group consisting of hydrogen, $C_1$-$C_{18}$ alkyl, $C_2$-$C_{18}$ alkenyl, ($C_0$-$C_4$ alkyl)$CONH_2$, ($C_0$-$C_4$ alkyl)COOH, ($C_0$-$C_4$ alkyl)$NH_2$, ($C_0$-$C_4$ alkyl)OH, and halo;

with the proviso that, if $R_1$ and $R_2$ are both independently an alkyl or ($C_0$-$C_4$ alkyl)($C_6$-$C_{10}$ aryl)$R_7$, either $R_1$ or $R_2$ is linked through $(CH_2)_p$ to $R_5$, wherein p is 2-9. In some embodiments the glucagon superfamily peptide is a glucagon related peptide. In any of these embodiments, the glucagon superfamily peptide is any of SEQ ID NOs: 1-684, 701-731, 801-919, 1001-1262, 1301-1371, 1401-1518, 1701-1776, and 1801-1908.

In some embodiments the dipeptide prodrug element is linked to a side chain amine of an internal amino acid of the glucagon superfamily peptide wherein the internal amino acid comprises the structure of Formula II:

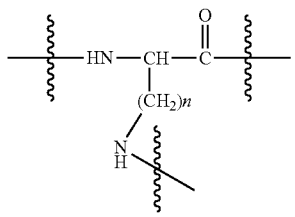

wherein n is an integer selected from 1 to 4. In some embodiments n is 3 or 4 and in some embodiments the internal amino acid is lysine. In some embodiments the dipeptide prodrug element is linked to a primary amine on a side chain of an amino acid located at position 12, 16, 17, 18, 20, 28, or 29 of the glucagon superfamily peptide. In some embodiments the amino acid at 12, 16, 17, 18, 20, 28, or 29 comprises the structure of Formula II:

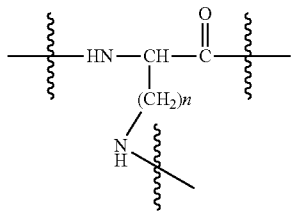

wherein n is an integer selected from 1 to 4 and the dipeptide prodrug element is linked to the amino acid side chain via an amide bond. In some embodiments n is 4 and the amino acid is located at position 20. In some embodiments the glucagon superfamily peptide is a glucagon related peptide.

In a further embodiment the dipeptide prodrug element is linked to the glucagon superfamily peptide via an amine present on an aryl group of an aromatic amino acid. In some embodiments the aromatic amino acid is an internal amino acid of the glucagon superfamily peptide, however the aromatic amino acid can also be the N-terminal amino acid. In some embodiments the glucagon superfamily peptide is a glucagon related peptide. In some embodiments the aromatic amino acid is selected from the group consisting of amino-Phe, amino-napthyl alanine, amino tryptophan, amino-phenyl-glycine, amino-homo-Phe, and amino tyrosine. In some embodiments the primary amine that forms an amide bond with the dipeptide prodrug element is in the para-position on the aryl group. In some embodiments the aromatic amine comprises the structure of Formula III:

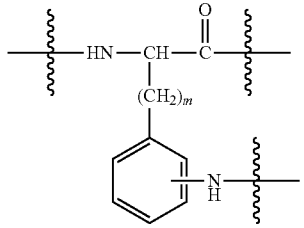

wherein m is an integer from 1 to 3.

For those embodiments wherein the dipeptide prodrug element is linked to the glucagon superfamily peptide via an amine present on an aryl group of an aromatic amino acid, prodrugs having a $t_{1/2}$, e.g., of about 1 hour have a dipeptide structure of:

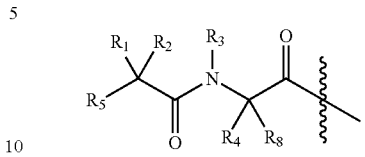

wherein $R_1$ and $R_2$ are independently $C_1$-$C_{18}$ alkyl or aryl; $R_3$ is $C_1$-$C_{18}$ alkyl or $R_3$ and $R_4$ together with the atoms to which they are attached form a 4-12 heterocyclic ring; $R_4$ and $R_8$ are independently selected from the group consisting of hydrogen, $C_1$-$C_{18}$ alkyl and aryl; and $R_5$ is an amine or a hydroxyl.

In some embodiments, the dipeptide prodrug element is linked to the glucagon superfamily peptide via an amine present on an aryl group of an aromatic amino acid, prodrugs having a $t_{1/2}$, e.g., of about 1 hour have a dipeptide structure of:

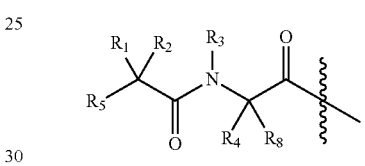

wherein $R_1$ and $R_2$ are independently $C_1$-$C_{18}$ alkyl or ($C_0$-$C_4$ alkyl)($C_6$-$C_{10}$ aryl)$R_7$;
$R_3$ is $C_1$-$C_{18}$ alkyl or $R_3$ and $R_4$ together with the atoms to which they are attached form a 4-12 heterocyclic ring;
$R_4$ and $R_8$ are independently selected from the group consisting of hydrogen, $C_1$-$C_{18}$ alkyl and ($C_0$-$C_4$ alkyl)($C_6$-$C_{10}$ aryl)$R_7$;
$R_5$ is $NH_2$ or OH; and
$R_7$ is selected from the group consisting of hydrogen, $C_1$-$C_{18}$ alkyl, $C_2$-$C_{18}$ alkenyl, ($C_0$-$C_4$ alkyl)$CONH_2$, ($C_0$-$C_4$ alkyl)COOH, ($C_0$-$C_4$ alkyl)$NH_2$, ($C_0$-$C_4$ alkyl)OH, and halo. In some embodiments the glucagon superfamily peptide is a glucagon related peptide. Furthermore, prodrugs having the dipeptide prodrug element is linked via an aromatic amino acid and having a $t_{1/2}$, e.g., of about 6 to about 24 hours are provided wherein the dipeptide comprises a structure of:

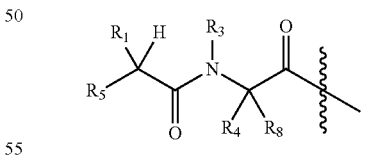

wherein $R_1$ is selected from the group consisting of hydrogen, $C_1$-$C_{18}$ alkyl and aryl, or $R_1$ and $R_2$ are linked through —$(CH_2)_p$—, wherein p is 2-9;
$R_3$ is $C_1$-$C_{18}$ alkyl or $R_3$ and $R_4$ together with the atoms to which they are attached form a 4-6 heterocyclic ring;
$R_4$ and $R_8$ are independently selected from the group consisting of hydrogen, $C_1$-$C_{18}$ alkyl and aryl; and $R_5$ is an amine or N-substituted amine.

In some embodiments, prodrugs having the dipeptide prodrug element linked via an aromatic amino acid and having a $t_{1/2}$, e.g., of about 6 to about 24 hours are provided wherein the dipeptide comprises a structure of:

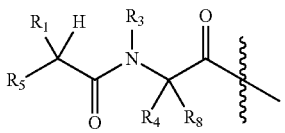

wherein $R_1$ is selected from the group consisting of hydrogen, $C_1$-$C_{18}$ alkyl, ($C_1$-$C_{18}$ alkyl)OH, ($C_1$-$C_4$ alkyl)NH$_2$, and ($C_0$-$C_4$ alkyl)($C_6$-$C_{10}$ aryl)$R_7$;

$R_3$ is $C_1$-$C_{18}$ alkyl or $R_3$ and $R_4$ together with the atoms to which they are attached form a 4-6 heterocyclic ring;

$R_4$ and $R_8$ are independently selected from the group consisting of hydrogen, $C_1$-$C_{18}$ alkyl and ($C_0$-$C_4$ alkyl)($C_6$-$C_{10}$ aryl)$R_7$;

$R_5$ is NHR$_6$;

$R_6$ is H, $C_1$-$C_8$ alkyl, or $R_6$ and $R_1$ together with the atoms to which they are attached form a 4, 5 or 6 member heterocyclic ring; and $R_7$ is selected from the group consisting of hydrogen, $C_1$-$C_{18}$ alkyl, $C_2$-$C_{18}$ alkenyl, ($C_0$-$C_4$ alkyl)CONH$_2$, ($C_0$-$C_4$ alkyl)COOH, ($C_0$-$C_4$ alkyl)NH$_2$, ($C_0$-$C_4$ alkyl)OH, and halo.

In addition, prodrugs having the dipeptide prodrug element is linked via an aromatic amino acid and having a $t_{1/2}$, e.g., of about 72 to about 168 hours are provided wherein the dipeptide comprises a structure of:

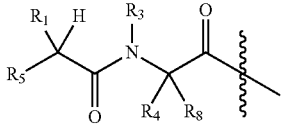

wherein $R_1$ and $R_2$ are independently selected from the group consisting of hydrogen, $C_1$-$C_8$ alkyl and aryl;

$R_3$ is $C_1$-$C_{18}$ alkyl or $R_3$ and $R_4$ together with the atoms to which they are attached form a 4-6 heterocyclic ring;

$R_4$ and $R_8$ are each hydrogen; and $R_5$ is selected from the group consisting of amine, N-substituted amine and hydroxyl.

In some embodiments, prodrugs having the dipeptide prodrug element linked via an aromatic amino acid and having a $t_{1/2}$, e.g., of about 72 to about 168 hours are provided wherein the dipeptide comprises a structure of:

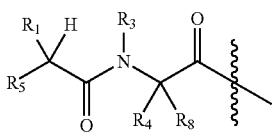

wherein $R_1$ and $R_2$ are independently selected from the group consisting of hydrogen, $C_1$-$C_8$ alkyl, ($C_1$-$C_4$ alkyl)COOH, and ($C_0$-$C_4$ alkyl)($C_6$-$C_{10}$ aryl)$R_7$, or $R_1$ and $R_5$ together with the atoms to which they are attached form a 4-11 heterocyclic ring;

$R_3$ is $C_1$-$C_{18}$ alkyl or $R_3$ and $R_4$ together with the atoms to which they are attached form a 4-6 heterocyclic ring;

$R_4$ is hydrogen or forms a 4-6 heterocyclic ring with $R_3$;

$R_8$ is hydrogen;

$R_5$ is NHR$_6$ or OH;

$R_6$ is H or $C_1$-$C_8$ alkyl, or $R_6$ and $R_1$ together with the atoms to which they are attached form a 4, 5 or 6 member heterocyclic ring; and $R_7$ is selected from the group consisting of hydrogen, $C_1$-$C_{18}$ alkyl, $C_2$-$C_{18}$ alkenyl, ($C_0$-$C_4$ alkyl)CONH$_2$, ($C_0$-$C_4$ alkyl)COOH, ($C_0$-$C_4$ alkyl)NH$_2$, ($C_0$-$C_4$ alkyl)OH, and halo.

In some embodiments the dipeptide prodrug element is linked to an aromatic amino acid via a primary amine present as an aryl substituent of the aromatic amino acid, wherein the aromatic amino acid is located at position 10, 13, 22, or 25 of the glucagon superfamily peptide (based on the numbering for glucagon, see e.g., FIG. 10). In some embodiments the dipeptide prodrug element linked aromatic amino acid amino acid is located at position 22 of the glucagon superfamily peptide.

In accordance with some embodiments the dipeptide prodrug element is linked at the N-terminal amine of a glucagon superfamily peptide, including for example a glucagon related peptide, or osteocalcin, as well as analogs, derivatives and conjugates of the foregoing, wherein the dipeptide prodrug element comprises the structure:

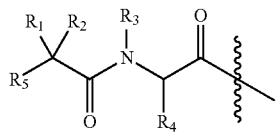

wherein $R_1$ is selected from the group consisting of H and $C_1$-$C_8$ alkyl;

$R_2$ and $R_4$ are independently selected from the group consisting of H, $C_1$-$C_8$ alkyl, $C_2$-$C_8$ alkenyl, ($C_1$-$C_4$ alkyl)OH, ($C_1$-$C_4$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2^+$)NH$_2$, ($C_0$-$C_4$ alkyl)($C_3$-$C_6$ cycloalkyl), ($C_0$-$C_4$ alkyl)($C_6$-$C_{10}$ aryl)$R_7$, CH$_2$($C_5$-$C_9$ heteroaryl), or $R_1$ and $R_2$ together with the atoms to which they are attached form a $C_3$-$C_6$ cycloalkyl;

$R_3$ is selected from the group consisting of $C_1$-$C_8$ alkyl, ($C_3$-$C_6$)cycloalkyl or $R_4$ and $R_3$ together with the atoms to which they are attached form a 5 or 6 member heterocyclic ring;

$R_5$ is NHR$_6$ or OH;

$R_6$ is H, or $R_6$ and $R_2$ together with the atoms to which they are attached form a 5 or 6 member heterocyclic ring; and $R_7$ is selected from the group consisting of H and OH. In some embodiments $R_1$ is H or $C_1$-$C_8$ alkyl, $R_2$ is selected from the group consisting of H, $C_1$-$C_6$ alkyl, CH$_2$OH, ($C_1$-$C_4$ alkyl)NH$_2$, ($C_3$-$C_6$ cycloalkyl) and CH$_2$($C_6$ aryl)$R_7$ or $R_6$ and $R_2$ together with the atoms to which they are attached form a 5 member heterocyclic ring, $R_3$ is $C_1$-$C_6$ alkyl, and $R_4$ is selected from the group consisting of H, $C_1$-$C_4$ alkyl, ($C_3$-$C_6$) cycloalkyl, ($C_1$-$C_4$ alkyl)OH, ($C_1$-$C_4$ alkyl)SH and ($C_0$-$C_4$ alkyl)($C_6$ aryl)$R_7$, or $R_3$ and $R_4$ together with the atoms to which they are attached form a 5 member heterocyclic ring. In a further embodiment $R_3$ is CH$_3$, $R_5$ is NHR$_6$, and in an alternative further embodiment $R_3$ and $R_4$ together with the atoms to which they are attached form a 5 member heterocyclic ring and $R_5$ is NHR$_6$.

In accordance with another embodiment the dipeptide prodrug element is linked at the N-terminal amine of a glucagon superfamily peptide, including for example a glucagon related peptide, or osteocalcin, as well as analogs, derivatives and conjugates of the foregoing, wherein the dipeptide prodrug element comprises the structure:

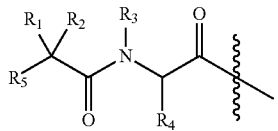

wherein $R_1$ is selected from the group consisting of H and $C_1$-$C_8$ alkyl;

$R_2$ and $R_4$ are independently selected from the group consisting of H, $C_1$-$C_8$ alkyl, $C_2$-$C_8$ alkenyl, ($C_1$-$C_4$ alkyl)OH, ($C_1$-$C_4$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2^+$)NH$_2$, ($C_0$-$C_4$ alkyl)($C_3$-$C_6$ cycloalkyl), ($C_0$-$C_4$ alkyl)($C_6$-$C_{10}$ aryl)$R_7$, $CH_2$($C_5$-$C_9$ heteroaryl), or $R_1$ and $R_2$ together with the atoms to which they are attached form a $C_3$-$C_6$ cycloalkyl;

$R_3$ is selected from the group consisting of $C_1$-$C_8$ alkyl, ($C_3$-$C_6$)cycloalkyl or $R_4$ and $R_3$ together with the atoms to which they are attached form a 5 or 6 member heterocyclic ring;

$R_5$ is NHR$_6$ or OH;

$R_6$ is H, or $R_6$ and $R_2$ together with the atoms to which they are attached form a 5 or 6 member heterocyclic ring; and $R_7$ is selected from the group consisting of hydrogen, $C_1$-$C_{18}$ alkyl, $C_2$-$C_{18}$ alkenyl, ($C_0$-$C_4$ alkyl)CONH$_2$, ($C_0$-$C_4$ alkyl)COOH, ($C_0$-$C_4$ alkyl)NH$_2$, ($C_0$-$C_4$ alkyl)OH, and halo. In some embodiments $R_1$ is H or $C_1$-$C_8$ alkyl, $R_2$ is selected from the group consisting of H, $C_1$-$C_6$ alkyl, CH$_2$OH, ($C_1$-$C_4$ alkyl)NH$_2$, ($C_3$-$C_6$ cycloalkyl) and CH$_2$($C_6$ aryl)$R_7$ or $R_6$ and $R_2$ together with the atoms to which they are attached form a 5 member heterocyclic ring, $R_3$ is $C_1$-$C_6$ alkyl, and $R_4$ is selected from the group consisting of H, $C_1$-$C_4$ alkyl, ($C_3$-$C_6$) cycloalkyl, ($C_1$-$C_4$ alkyl)OH, ($C_1$-$C_4$ alkyl)SH and ($C_0$-$C_4$ alkyl)($C_6$ aryl)$R_7$, or $R_3$ and $R_4$ together with the atoms to which they are attached form a 5 member heterocyclic ring. In a further embodiment $R_3$ is CH$_3$, $R_5$ is NHR$_6$, and in an alternative further embodiment $R_3$ and $R_4$ together with the atoms to which they are attached form a 5 member heterocyclic ring and $R_5$ is NHR$_6$.

In some embodiments, Q is any of SEQ ID NOs: 1-684, 701-731, 801-919, 1001-1262, 1301-1371, 1401-1518, 1701-1776, and 1801-1908.

Glucagon Related Peptides

In certain aspects the instant disclosure concerns glucagon related peptides (as part of the designated group "Q"). The term glucagon related peptide refers to those peptides which have biological activity (as agonists or antagonists) at any one or more of the glucagon, GLP-1, GLP-2, and GIP receptors and comprise an amino acid sequence that shares at least 40% sequence identity (e.g., 45%, 50%, 55%, 60%, 65%, 70%, 75%, 80%, 85%, 90%, 95%) with at least one of native glucagon, native oxyntomodulin, native exendin-4, native GLP-1, native GLP-2, or native GIP. It is understood that all possible activity subsets of glucagon related peptides are contemplated, e.g. peptides which have biological activity (as agonists or antagonists) at any one or more of the glucagon or GLP-1 or GIP receptors, together with all possible subsets of sequence identity to each listed native peptide, e.g., comprise an amino acid sequence that shares at least 40%, 45%, 50%, 55%, 60%, 65%, 70%, 75%, 80%, 85%, 90%, or 95% sequence identity with native glucagon over the length of native glucagon. In some embodiments of the invention, the glucagon related peptide is a peptide having glucagon receptor agonist activity, GIP receptor agonist activity, glucagon receptor/GLP-1 receptor co-agonist activity, glucagon receptor antagonist activity, or glucagon receptor antagonist & GLP-1 receptor agonist activity. In some embodiments, the peptide retains an alpha-helix conformation in the C-terminal half of the molecule. In some embodiments, the peptide retains positions involved in receptor interaction or signaling, e.g. position 3 of glucagon, or position 7, 10, 12, 13, 15 or 17 of (1-37)GLP-1. Accordingly, the glucagon related peptide can be a peptide of Class 1, Class 2, Class 3, Class 4, and/or Class 5, each of which is further described herein.

In accordance with some embodiments the dipeptide prodrug element can be attached via an amide linkage to any of the bioactive compounds previously disclosed in International application nos. PCT/US2008/08608 (filed on Jan. 3, 2008), PCT/US2008/053857 (filed on Feb. 13, 2008), PCT/US2009/47437 (filed on Jun. 16, 2009), PCT/US2009/47438 (filed on Jun. 16, 2009), PCT/US2009/47447 (filed on Jun. 16, 2009), PCT/US2008/080973 (filed on Oct. 23, 2008), and PCT/US2008/081333 (filed on Oct. 27, 2008), the disclosures of which are hereby expressly incorporated by reference into the present application. The dipeptide prodrug element disclosed herein can, in some exemplary embodiments, be linked to the bioactive peptides disclosed in PCT/US2008/08608, PCT/US2008/053857, PCT/US2009/47437, PCT/US2009/47438, PCT/US2009/47447, PCT/US2008/08097, and PCT/US2008/081333 either through the N-terminal amine or to the side chain amino group of a lysine at position 20 or the aromatic amino group of a 4-amino phenylalanine substituted for the amino acid at position 22 of any of the disclosed bioactive peptides. In some exemplary embodiments the dipeptide prodrug element disclosed herein is linked via an amide bond to the N-terminal amine of a bioactive peptide disclosed in PCT/US2008/08608, PCT/US2008/053857, PCT/US2009/47437, PCT/US2009/47438, PCT/US2009/47447, PCT/US2008/08097, and PCT/US2008/081333. In some embodiments, the glucagon superfamily peptide is any of SEQ ID NOs: 1-684, 701-731, 801-919, 1001-1262, 1301-1371, 1401-1518, 1701-1776, and 1801-1908.

Modifications

The glucagon related peptide can comprise the native glucagon amino acid sequence (SEQ ID NO; 701) with modifications. In exemplary embodiments, the glucagon related peptide may comprise a total of 1, up to 2, up to 3, up to 4, up to 5, up to 6, up to 7, up to 8, up to 9, or up to 10 amino acid modifications relative to the native glucagon sequence, e.g. conservative or non-conservative substitutions. Modifications and substitutions described herein are, in certain aspects made at specific positions within a glucagon related peptide wherein the numbering of the position corresponds to the numbering of glucagon (SEQ ID NO: 701). In some embodiments 1, 2, 3, 4 or 5 non-conservative substitutions are carried out at any of positions 2, 5, 7, 10, 11, 12, 13, 14, 17, 18, 19, 20, 21, 24, 27, 28 or 29 and up to 5 further conservative substitutions are carried out at any of these positions. In some embodiments 1, 2, or 3 amino acid modifications are carried out within amino acids at positions 1-16, and 1, 2 or 3 amino acid modifications are carried out within amino acids at positions 17-26. In some embodiments, such glucagon related peptides retain at least 22, 23, 24, 25, 26, 27 or 28 of the naturally occurring amino acids at the corresponding positions in native glucagon (e.g. have 1-7, 1-5 or 1-3 modifications relative to naturally occurring glucagon).

DPP-IV Resistance

In some embodiments, the glucagon related peptide comprises a modification at position 1 or 2 to reduce susceptibility to cleavage by dipeptidyl peptidase IV. More particularly, in some embodiments, position 1 of a glucagon related peptide (e.g., selected from those in FIG. 10) is substituted with an amino acid selected from the group consisting of D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine. More particularly, in some embodiments, position 2 of the glucagon related peptide is substituted with an amino acid selected from the group consisting of D-serine, D-alanine, valine, glycine, N-methyl serine, and aminoisobutyric acid. In some embodiments, position 2 of the glucagon related peptide is not D-serine.

Hydrophilic Moieties

In some embodiments, the glucagon related peptide, (e.g., a Class 1 glucagon related peptide, Class 2 glucagon related peptide, Class 3 glucagon related peptide, Class 4 glucagon related peptides or Class 5 glucagon related peptide) is attached (covalently bonded) to a hydrophilic moiety. Hydrophilic moieties can be attached to the glucagon related peptide under any suitable conditions used to react a protein with an activated polymer molecule. Any means known in the art can be used, including via acylation, reductive alkylation, Michael addition, thiol alkylation or other chemoselective conjugation/ligation methods through a reactive group on the PEG moiety (e.g., an aldehyde, amino, ester, thiol, α-haloacetyl, maleimido or hydrazino group) to a reactive group on the target compound (e.g., an aldehyde, amino, ester, thiol, α-haloacetyl, maleimido or hydrazino group). Activating groups which can be used to link the water soluble polymer to one or more proteins include without limitation sulfone, maleimide, sulfhydryl, thiol, triflate, tresylate, azidirine, oxirane and 5-pyridyl. If attached to the peptide by reductive alkylation, the polymer selected should have a single reactive aldehyde so that the degree of polymerization is controlled. See, for example, Kinstler et al., *Adv. Drug. Delivery Rev.* 54: 477-485 (2002); Roberts et al., *Adv. Drug Delivery Rev.* 54: 459-476 (2002); and Zalipsky et al., *Adv. Drug Delivery Rev.* 16: 157-182 (1995).

With regard to the glucagon related peptides of Classes 1 to 3, further activating groups which can be used to link the water soluble polymer to one or more proteins include an alpha-halogenated acyl group (e.g., alpha-iodo acetic acid, alpha-bromoacetic acid, alpha-chloroacetic acid). In some embodiments, wherein the glucagon related peptide is a Class 1, Class 2, or Class 3 glucagon related peptide, an amino acid comprising a thiol is modified with maleimide-activated PEG in a Michael addition reaction to result in a PEGylated peptide comprising the thioether linkage shown below:

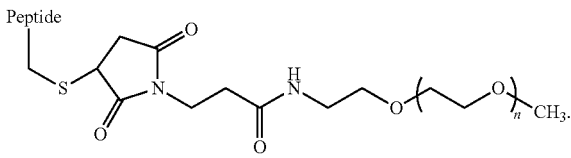

In other embodiments, the thiol of an amino acid of a Class 1, Class 2, or Class 3 glucagon related peptide is modified with a haloacetyl-activated PEG in a nucleophilic substitution reaction to result in a PEGylated peptide comprising the thioether linkage shown below:

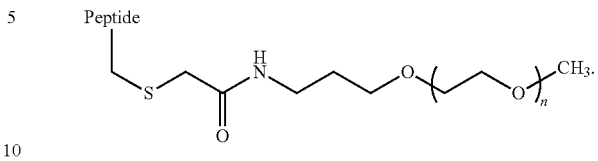

Suitable hydrophilic moieties include polyethylene glycol (PEG), polypropylene glycol, polyoxyethylated polyols (e.g., POG), polyoxyethylated sorbitol, polyoxyethylated glucose, polyoxyethylated glycerol (POG), polyoxyalkylenes, polyethylene glycol propionaldehyde, copolymers of ethylene glycol/propylene glycol, monomethoxy-polyethylene glycol, mono-(C1-C10) alkoxy- or aryloxy-polyethylene glycol, carboxymethylcellulose, polyacetals, polyvinyl alcohol (PVA), polyvinyl pyrrolidone, poly-1,3-dioxolane, poly-1,3,6-trioxane, ethylene/maleic anhydride copolymer, poly(.beta.-amino acids) (either homopolymers or random copolymers), poly(n-vinyl pyrrolidone)polyethylene glycol, propropylene glycol homopolymers (PPG) and other polyakylene oxides, polypropylene oxide/ethylene oxide copolymers, colonic acids or other polysaccharide polymers, Ficoll or dextran and mixtures thereof. Dextrans are polysaccharide polymers of glucose subunits, predominantly linked by α1-6 linkages. Dextran is available in many molecular weight ranges, e.g., about 1 kD to about 100 kD, or from about 5, 10, 15 or 20 kD to about 20, 30, 40, 50, 60, 70, 80 or 90 kD.

In some embodiments the hydrophilic moiety is a polyethylene glycol (PEG) chain or other water soluble polymer that is covalently linked to the side chain of an amino acid residue at one or more of positions 16, 17, 21, 24, 29, 40 of said glucagon related peptide, within a C-terminal extension, or at the C-terminal amino acid. In some embodiments, the native amino acid at that position is substituted with an amino acid having a side chain suitable for crosslinking with hydrophilic moieties, to facilitate linkage of the hydrophilic moiety to the peptide. Exemplary amino acids include Cys, Lys, Orn, homo-Cys, or acetyl phenylalanine (Ac-Phe). In other embodiments, an amino acid modified to comprise a hydrophilic group is added to the peptide at the C-terminus.

The hydrophilic moiety, e.g., polyethylene glycol chain, in accordance with some embodiments has a molecular weight selected from the range of about 500 to about 40,000 Daltons. In some embodiments the polyethylene glycol chain has a molecular weight selected from the range of about 500 to about 5,000 Daltons, or about 1,000 to about 5,000 Daltons. In another embodiment the hydrophilic moiety, e.g., polyethylene glycol chain, has a molecular weight of about 10,000 to about 20,000 Daltons. In yet other exemplary embodiments the hydrophilic moiety, e.g. polyethylene glycol chain, has a molecular weight of about 20,000 to about 40,000 Daltons.

Linear or branched hydrophilic polymers are contemplated. Resulting preparations of conjugates may be essentially monodisperse or polydisperse, and may have about 0.5, 0.7, 1, 1.2, 1.5 or 2 polymer moieties per peptide.

Acylation

In some embodiments, the glucagon related peptide (e.g. a Class 1 glucagon related peptide, Class 2 glucagon related peptide, Class 3 glucagon related peptide, Class 4 glucagon related peptide, Class 4 glucagon related peptides or Class 5 glucagon related peptide), is modified to comprise an acyl group. For example, the glucagon related peptide may be one of Class 1, Class 2, or Class 3, and may comprise an acyl group which is non-native to a naturally-occurring amino acid. Acylation can be carried out at any position within the glucagon related peptide, including any of positions 1-29, a position within a C-terminal extension, or the C-terminal amino acid, provided that the activity exhibited by the non-acylated glucagon related peptide is retained upon acylation. For example, if the unacylated peptide has glucagon agonist activity, then the acylated peptide retains the glucagon agonist activity. Also for example, if the unacylated peptide has glucagon antagonist activity, then the acylated peptide retains the glucagon antagonist activity. For instance, if the unacylated peptide has GLP-1 agonist activity, then the acylated peptide retains GLP-1 agonist activity. Nonlimiting examples include acylation at positions 5, 7, 10, 11, 12, 13, 14, 16, 17, 18, 19, 20, 21, 24, 27, 28, or 29 (according to the amino acid numbering of wild type glucagon). With regard to Class 1, Class 2, and Class 3 glucagon related peptides, acylation may occur at any of positions 5, 7, 10, 11, 12, 13, 14, 16, 17, 18, 19, 20, 21, 24, 27, 28, 29, 30, 37, 38, 39, 40, 41, 42, or 43 (according to the amino acid numbering of wild type glucagon). The acyl group can be covalently linked directly to an amino acid of the glucagon related peptide, or indirectly to an amino acid of the glucagon related peptide via a spacer, wherein the spacer is positioned between the amino acid of the glucagon related peptide and the acyl group. Glucagon related peptides may be acylated at the same amino acid position where a hydrophilic moiety is linked, or at a different amino acid position. Nonlimiting examples include acylation at position 10 (according to the amino acid numbering of the wild type glucagon) and pegylation at one or more positions in the C-terminal portion of the glucagon peptide, e.g., position 24, 28 or 29 (according to the amino acid numbering of the wild type glucagon), within a C-terminal extension, or at the C-terminus (e.g., through adding a C-terminal Cys).

In a specific aspect of the invention, the glucagon related peptide is modified to comprise an acyl group by direct acylation of an amine, hydroxyl, or thiol of a side chain of an amino acid of the glucagon related peptide. In some embodiments, the glucagon related peptide is directly acylated through the side chain amine, hydroxyl, or thiol of an amino acid. In some embodiments, acylation is at position 10, 20, 24, or 29 (according to the amino acid numbering of the wild type glucagon). In this regard, the acylated glucagon related peptide can comprise the amino acid sequence of SEQ ID NO: 701, or a modified amino acid sequence thereof comprising one or more of the amino acid modifications described herein, with at least one of the amino acids at positions 10, 20, 24, and 29 (according to the amino acid numbering of the wild type glucagon) modified to any amino acid comprising a side chain amine, hydroxyl, or thiol. In some specific embodiments of the invention, the direct acylation of the glucagon related peptide occurs through the side chain amine, hydroxyl, or thiol of the amino acid at position 10 (according to the amino acid numbering of the wild type glucagon).

In some embodiments, the amino acid comprising a side chain amine is an amino acid of Formula I:

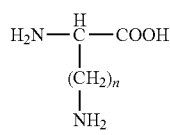

[Formula I]

wherein n = 1 to 4

In some exemplary embodiments, the amino acid of Formula I, is the amino acid wherein n is 4 (Lys) or n is 3 (Orn).

In other embodiments, the amino acid comprising a side chain hydroxyl is an amino acid of Formula II:

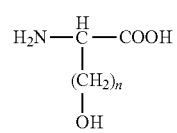

[Formula II]

wherein n = 1 to 4

In some exemplary embodiments, the amino acid of Formula II is the amino acid wherein n is 1 (Ser).

In yet other embodiments, the amino acid comprising a side chain thiol is an amino acid of Formula III:

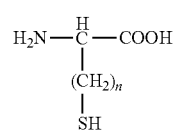

[Formula III]

wherein n = 1 to 4

In some exemplary embodiments, the amino acid of Formula III is the amino acid wherein n is 1 (Cys).

In yet other embodiments, in which the glucagon related peptide is a Class 1, Class 2, or Class 3 glucagon related peptide, the amino acid comprising a side chain amine, hydroxyl, or thiol is a disubstituted amino acid comprising the same structure of Formula I, Formula II, or Formula III, except that the hydrogen bonded to the alpha carbon of the amino acid of Formula I, Formula II, or Formula III is replaced with a second side chain.

In some embodiments of the invention, the acylated glucagon related peptide comprises a spacer between the peptide and the acyl group. In some embodiments, the glucagon related peptide is covalently bound to the spacer, which is covalently bound to the acyl group. In some exemplary embodiments, the glucagon related peptide is modified to comprise an acyl group by acylation of an amine, hydroxyl, or thiol of a spacer, which spacer is attached to a side chain of an amino acid at position 10, 20, 24, or 29 (according to the amino acid numbering of the wild type glucagon), or at the C-terminal amino acid of the glucagon related peptide. The amino acid to which the spacer is attached can be any amino acid comprising a moiety which permits linkage to the spacer. For example, an amino acid comprising a side chain —NH$_2$, —OH, or —COOH (e.g., Lys, Orn, Ser, Asp, or Glu) is suitable. Also, with regard to Class 1, Class 2, and Class 3 glucagon related peptides, an amino acid (e.g., a singly or doubly α-substituted amino acid) comprising a side chain —NH$_2$, —OH, or —COOH (e.g., Lys, Orn, Ser, Asp, or Glu) is suitable. In this respect, the acylated glucagon related peptide can comprise the amino acid sequence of SEQ ID NO: 701, or a modified amino acid sequence thereof comprising one or more of the amino acid modifications described herein, with at least one of the amino acids at positions 10, 20, 24, and 29 (according to the amino acid numbering of the wild type glucagon) modified to any amino acid comprising a side chain amine, hydroxyl, or carboxylate.

In some embodiments, the spacer is an amino acid comprising a side chain amine, hydroxyl, or thiol, or a dipeptide or tripeptide comprising an amino acid comprising a side chain amine, hydroxyl, or thiol. In some embodiments, the amino acid spacer is not γ-Glu. In some embodiments, the dipeptide spacer is not γ-Glu-γ-Glu.

When acylation occurs through an amine group of the amino acid of the spacer, the acylation can occur through the alpha amine of the amino acid or a side chain amine. In the instance in which the alpha amine is acylated, the spacer amino acid can be any amino acid. For example, the spacer amino acid can be a hydrophobic amino acid, e.g., Gly, Ala, Val, Leu, Ile, Trp, Met, Phe, Tyr. In some embodiments in which the glucagon related peptide is a Class 1, Class 2, or Class 3 glucagon related peptide, the spacer amino acid can be, for example, a hydrophobic amino acid, e.g., Gly, Ala, Val, Leu, Ile, Trp, Met, Phe, Tyr, 6-amino hexanoic acid, 5-aminovaleric acid, 7-aminoheptanoic acid, 8-aminooctanoic acid. Alternatively, the spacer amino acid can be an acidic residue, e.g., Asp and Glu. In the instance in which the side chain amine of the spacer amino acid is acylated, the spacer amino acid is an amino acid comprising a side chain amine, e.g., an amino acid of Formula I (e.g., Lys or Orn). In this instance, it is possible for both the alpha amine and the side chain amine of the spacer amino acid to be acylated, such that the glucagon peptide is diacylated. Embodiments of the invention include such diacylated molecules.

When acylation occurs through a hydroxyl group of the amino acid of the spacer, the amino acid or one of the amino acids of the dipeptide or tripeptide can be an amino acid of Formula II. In a specific exemplary embodiment, the amino acid is Ser.

When acylation occurs through a thiol group of the amino acid of the spacer, the amino acid or one of the amino acids of the dipeptide or tripeptide can be an amino acid of Formula III. In a specific exemplary embodiment, the amino acid is Cys.

In some embodiments, the spacer comprises a hydrophilic bifunctional spacer. In a specific embodiment, the spacer comprises an amino poly(alkyloxy)carboxylate. In this regard, the spacer can comprise, for example, $NH_2(CH_2CH_2O)_n(CH_2)_mCOOH$, wherein m is any integer from 1 to 6 and n is any integer from 2 to 12, such as, e.g., 8-amino-3,6-dioxaoctanoic acid, which is commercially available from Peptides International, Inc. (Louisville, Ky.).

In some embodiments, pertaining only to Class 1, Class 2, and Class 3 glucagon related peptides, the spacer comprises a hydrophilic bifunctional spacer. In certain embodiments, the hydrophilic bifunctional spacer attached to the Class 1, Class 2, or Class 3 glucagon related peptide comprises two or more reactive groups, e.g., an amine, a hydroxyl, a thiol, and a carboxyl group or any combinations thereof. In certain embodiments, the hydrophilic bifunctional spacer attached to the Class 1, Class 2, or Class 3 glucagon related peptide comprises a hydroxyl group and a carboxylate. In other embodiments, the hydrophilic bifunctional spacer attached to the Class 1, Class 2, or Class 3 glucagon related peptide comprises an amine group and a carboxylate. In other embodiments, the hydrophilic bifunctional spacer attached to the Class 1, Class 2, or Class 3 glucagon related peptide comprises a thiol group and a carboxylate.

In some embodiments in which the glucagon related peptide is a Class 1, Class 2, or Class 3 glucagon related peptide, the spacer is a hydrophobic bifunctional spacer. Hydrophobic bifunctional spacers are known in the art. See, e.g., *Bioconjugate Techniques*, G. T. Hermanson (Academic Press, San Diego, Calif., 1996), which is incorporated by reference in its entirety. In certain embodiments, the hydrophobic bifunctional spacer attached to the Class 1, Class 2, or Class 3 glucagon related peptide comprises two or more reactive groups, e.g., an amine, a hydroxyl, a thiol, and a carboxyl group or any combinations thereof. In certain embodiments, the hydrophobic bifunctional spacer attached to the Class 1, Class 2, or Class 3 glucagon related peptide comprises a hydroxyl group and a carboxylate. In other embodiments, the hydrophobic bifunctional spacer attached to the Class 1, Class 2, or Class 3 glucagon related peptide comprises an amine group and a carboxylate. In other embodiments, the hydrophobic bifunctional spacer attached to the Class 1, Class 2, or Class 3 glucagon related peptide comprises a thiol group and a carboxylate. Suitable hydrophobic bifunctional spacers comprising a carboxylate and a hydroxyl group or a thiol group are known in the art and include, for example, 8-hydroxyoctanoic acid and 8-mercaptooctanoic acid.

In some embodiments, the bifunctional spacer attached to the Class 1, Class 2, or Class 3 glucagon related peptide is not a dicarboxylic acid comprising an unbranched, methylene of 1 to 7 carbon atoms between the carboxylate groups. In some embodiments, the bifunctional spacer attached to the Class 1, Class 2, or Class 3 glucagon related peptide is a dicarboxylic acid comprising an unbranched, methylene of 1-7 carbon atoms between the carboxylate groups.

The spacer (e.g., amino acid, dipeptide, tripeptide, hydrophilic bifunctional spacer, or hydrophobic bifunctional spacer) in specific embodiments, wherein the glucagon related peptide is a Class 1, Class 2, or Class 3 glucagon related peptide, is 3 to 10 atoms (e.g., 6 to 10 atoms, (e.g., 6, 7, 8, 9, or 10 atoms) in length. In more specific embodiments in which the glucagon related peptide is a Class 1, Class 2, or Class 3 glucagon related peptide, the spacer is about 3 to 10 atoms (e.g., 6 to 10 atoms) in length and the acyl group is a C12 to C18 fatty acyl group, e.g., C14 fatty acyl group, C16 fatty acyl group, such that the total length of the spacer and acyl group is 14 to 28 atoms, e.g., about 14, 15, 16, 17, 18, 19, 20, 21, 22, 23, 24, 25, 26, 27, or 28 atoms. In some embodiments, in which the glucagon related peptide is a Class 1, Class 2, or Class 3 glucagon related peptide the length of the spacer and acyl group is 17 to 28 (e.g., 19 to 26, 19 to 21) atoms.

In accordance with certain embodiments in which the glucagon related peptide is a Class 1, Class 2, or Class 3 glucagon related peptide, the bifunctional spacer can be a synthetic or naturally occurring amino acid (including, but not limited to, any of those described herein) comprising an amino acid backbone that is 3 to 10 atoms in length (e.g., 6-amino hexanoic acid, 5-aminovaleric acid, 7-aminoheptanoic acid, and 8-aminooctanoic acid). Alternatively, the spacer attached to the Class 1, Class 2, or Class 3 glucagon related peptide can be a dipeptide or tripeptide spacer having a peptide backbone that is 3 to 10 atoms (e.g., 6 to 10 atoms) in length. Each amino acid of the dipeptide or tripeptide spacer attached to the Class 1, Class 2, or Class 3 glucagon related peptide can be the same as or different from the other amino acid(s) of the dipeptide or tripeptide and can be independently selected from the group consisting of: naturally-occurring and/or non-naturally occurring amino acids, including, for example, any of the D or L isomers of the naturally-occurring amino acids (Ala, Cys, Asp, Glu, Phe, Gly, His, Ile, Lys, Leu, Met, Asn, Pro, Arg, Ser, Thr, Val, Trp, Tyr), or any D or L isomers of the non-naturally occurring amino acids selected from the group consisting of: β-alanine (β-Ala), N-α-methyl-alanine (Me-Ala), aminobutyric acid (Abu), γ-aminobutyric acid (γ-Abu), aminohexanoic acid (ε-Ahx), aminoisobutyric acid (Aib), aminomethylpyrrole carboxylic acid, aminopiperidinecarboxylic acid, aminoserine (Ams), aminotetrahydro yran-4-carboxylic acid, arginine N-methoxy-N-methyl amide, β-aspartic acid (β-Asp), azetidine carboxylic acid, 3-(2-benzothiazolyl)alanine, α-tert-butylglycine, 2-amino-5-ureido-n-valeric acid (citrulline, Cit), β-Cyclohexylalanine (Cha), acetamidomethyl-cysteine, diaminobutanoic acid (Dab), diaminopropionic acid (Dpr), dihydroxyphenylalanine (DOPA), dimethylthiazolidine (DMTA), γ-Glutamic acid (γ-Glu), homoserine (Hse), hydroxyproline (Hyp), isoleucine N-methyl-N-methyl amide, methyl-isoleucine (MeIle), isonipecotic acid (Isn), methyl-leucine (MeLeu), methyl-lysine, dimethyl-lysine, trimethyl-lysine, methanoproline, methionine-sulfoxide (Met(O)), methionine-sulfone (Met($O_2$)), norleucine (Nle), methyl-norleucine (Me-Nle), norvaline (Nva), ornithine (Orn), para-aminobenzoic acid (PABA), penicillamine (Pen), methylphenylalanine (MePhe), 4-Chlorophenylalanine (Phe(4-Cl)), 4-fluorophenylalanine (Phe(4-F)), 4-nitrophenylalanine (Phe(4-$NO_2$)), 4-cyanophenylalanine ((Phe(4-CN)), phenylglycine (Phg), piperidinylalanine, piperidinylglycine, 3,4-dehydroproline, pyrrolidinylalanine, sarcosine (Sar), selenocysteine (Sec), O-Benzyl-phosphoserine, 4-amino-3-hydroxy-6-methylheptanoic acid (Sta), 4-amino-5-cyclohexyl-3-hydroxypentanoic acid (ACHPA), 4-amino-3-hydroxy-5-phenylpentanoic acid (AHPPA), 1,2,3,4-tetrahydro-isoquinoline-3-carboxylic acid (Tic), tetrahydropyranglycine, thienylalanine (Thi), O-benzyl-phosphotyrosine, O-Phosphotyrosine, methoxytyrosine, ethoxytyrosine, O-(bis-dimethylamino-phosphono)-tyrosine, tyrosine sulfate tetrabutylamine, methyl-valine (Me-Val), and alkylated 3-mercaptopropionic acid.

In some embodiments in which the glucagon related peptide is a Class 1, Class 2, or Class 3 glucagon related peptide, the spacer comprises an overall negative charge, e.g., comprises one or two negatively charged amino acids. In some embodiments in which the glucagon related peptide is a Class 1, Class 2, or Class 3 glucagon related peptide, the dipeptide is not any of the dipeptides of general structure A-B, wherein A is selected from the group consisting of Gly, Gln, Ala, Arg, Asp, Asn, Ile, Leu, Val, Phe, and Pro, wherein B is selected from the group consisting of Lys, His, Trp. In some embodiments in which the glucagon related peptide is a Class 1, Class 2, or Class 3 glucagon related peptide, the dipeptide spacer is selected from the group consisting of: Ala-Ala, β-Ala-β-Ala, Leu-Leu, Pro-Pro, γ-aminobutyric acid-γ-aminobutyric acid, and γ-Glu-γ-Glu.

In some embodiments of the invention in which the glucagon related peptide is a Class 1, Class 2, or Class 3 glucagon related peptide, the glucagon related peptide is modified to comprise an acyl group by acylation of a long chain alkane by the glucagon related peptide. In specific aspects in which the glucagon related peptide is a Class 1, Class 2, or Class 3 glucagon related peptide, the long chain alkane comprises an amine, hydroxyl, or thiol group (e.g. octadecylamine, tetradecanol, and hexadecanethiol) which reacts with a carboxyl group, or activated form thereof, of the glucagon related peptide. The carboxyl group, or activated form thereof, of the Class 1, Class 2, or Class 3 glucagon related peptide can be part of a side chain of an amino acid (e.g., glutamic acid, aspartic acid) of the glucagon related peptide or can be part of the peptide backbone.

In certain embodiments, the Class 1, Class 2, or Class 3 glucagon related peptide is modified to comprise an acyl group by acylation of the long chain alkane by a spacer which is attached to the glucagon peptide. In specific aspects, the long chain alkane comprises an amine, hydroxyl, or thiol group which reacts with a carboxyl group, or activated form thereof, of the spacer. Suitable spacers comprising a carboxyl group, or activated form thereof, are described herein and include, for example, bifunctional spacers, e.g., amino acids, dipeptides, tripeptides, hydrophilic bifunctional spacers and hydrophobic bifunctional spacers.

As used herein, the term "activated form of a carboxyl group" refers to a carboxyl group with the general formula R(C=O)X, wherein X is a leaving group and R is the glucagon related peptide or the spacer. For example, activated forms of a carboxyl groups may include, but are not limited to, acyl chlorides, anhydrides, and esters. In some embodiments, the activated carboxyl group is an ester with a N-hydroxysuccinimide (NHS) leaving group.

With regard to these aspects of the invention, in which a long chain alkane is acylated by the Class 1, Class 2, or Class 3 glucagon related peptide or the spacer, the long chain alkane may be of any size and can comprise any length of carbon chain. The long chain alkane can be linear or branched. In certain aspects in which the glucagon related peptide is a Class 1, Class 2, or Class 3 glucagon related peptide, the long chain alkane is a C4 to C30 alkane. For example, the long chain alkane can be any of a C4 alkane, C6 alkane, C8 alkane, C10 alkane, C12 alkane, C14 alkane, C16 alkane, C18 alkane, C20 alkane, C22 alkane, C24 alkane, C26 alkane, C28 alkane, or a C30 alkane. In some embodiments in which the glucagon related peptide is a Class 1, Class 2, or Class 3 glucagon related peptide, the long chain alkane comprises a C8 to C20 alkane, e.g., a C14 alkane, C16 alkane, or a C18 alkane.

Also, in some embodiments in which the glucagon related peptide is a Class 1, Class 2, or Class 3 glucagon related peptide, an amine, hydroxyl, or thiol group of the glucagon related peptide is acylated with a cholesterol acid. In a specific embodiment, the Class 1, Class 2, or Class 3 glucagon related peptide is linked to the cholesterol acid through an alkylated desamino Cys spacer, i.e., an alkylated 3-mercaptopropionic acid spacer.

Suitable methods of peptide acylation via amines, hydroxyls, and thiols are known in the art. See, for example, Miller, *Biochem Biophys Res Commun* 218: 377-382 (1996); Shimohigashi and Stammer, *Int J Pept Protein Res* 19: 54-62 (1982); and Previero et al., *Biochim Biophys Acta* 263: 7-13 (1972) (for methods of acylating through a hydroxyl); and San and Silvius, *J Pept Res* 66: 169-180 (2005) (for methods of acylating through a thiol); *Bioconjugate Chem.* "Chemical Modifications of Proteins: History and Applications" pages 1, 2-12 (1990); Hashimoto et al., *Pharmacuetical Res.* "Synthesis of Palmitoyl Derivatives of Insulin and their Biological Activity" Vol. 6, No: 2 pp. 171-176 (1989).

The acyl group of the acylated glucagon related peptide can be of any size, e.g., any length carbon chain, and can be linear or branched. In some specific embodiments of the invention, the acyl group is a C4 to C30 fatty acid. For example, the acyl group can be any of a C4 fatty acid, C6 fatty acid, C8 fatty acid, C10 fatty acid, C12 fatty acid, C14 fatty acid, C16 fatty acid, C18 fatty acid, C20 fatty acid, C22 fatty acid, C24 fatty acid, C26 fatty acid, C28 fatty acid, or a C30 fatty acid. In some embodiments, the acyl group is a C8 to C20 fatty acid, e.g., a C14 fatty acid or a C16 fatty acid.

In an alternative embodiment, the acyl group is a bile acid. The bile acid can be any suitable bile acid, including, but not limited to, cholic acid, chenodeoxycholic acid, deoxycholic acid, lithocholic acid, taurocholic acid, glycocholic acid, and cholesterol acid.

The acylated glucagon related peptides described herein can be further modified to comprise a hydrophilic moiety. In some specific embodiments the hydrophilic moiety can comprise a polyethylene glycol (PEG) chain. The incorporation of a hydrophilic moiety can be accomplished through any suitable means, such as any of the methods described herein. In this regard, the acylated glucagon related peptide can comprise SEQ ID NO: 701, including any of the modifications described herein, in which at least one of the amino acids at position 10, 20, 24, and 29 (according to the amino acid numbering of the wild type glucagon) comprise an acyl group and at least one of the amino acids at position 16, 17, 21, 24, or 29 (according to the amino acid numbering of the wild type glucagon), a position within a C-terminal extension, or the C-terminal amino acid are modified to a Cys, Lys, Orn, homo-Cys, or Ac-Phe, and the side chain of the amino acid is covalently bonded to a hydrophilic moiety (e.g., PEG). In some embodiments, the acyl group is attached to position 10 (according to the amino acid numbering of the wild type glucagon), optionally via a spacer comprising Cys, Lys, Orn, homo-Cys, or Ac-Phe, and the hydrophilic moiety is incorporated at a Cys residue at position 24.

Alternatively, the acylated glucagon related peptide can comprise a spacer, wherein the spacer is both acylated and modified to comprise the hydrophilic moiety. Nonlimiting examples of suitable spacers include a spacer comprising one or more amino acids selected from the group consisting of Cys, Lys, Orn, homo-Cys, and Ac-Phe.

Alkylation

In accordance with some embodiments, the glucagon related peptide, e.g., a Class 1 glucagon related peptide, Class 2 glucagon related peptide, Class 3 glucagon related peptide, Class 4 glucagon peptide, or Class 5 glucagion related peptide, is modified to comprise an alkyl group which is attached to the glucagon related peptide via an ether, thioether, or amino linkage for purposes of prolonging half-life in circulation and/or delaying the onset of and/or extending the duration of action and/or improving resistance to proteases such as DPP-IV. In exemplary embodiments in which the glucagon related peptide is a Class 1, Class 2, or Class 3 glucagon related peptide, the glucagon related peptide comprises an alkyl group which is non-native to a naturally-occurring amino acid.

Alkylation can be carried out at any position within the glucagon related peptide, including any of positions 1-29, a position within a C-terminal extension, or the C-terminal amino acid, provided that an agonist or antagonist activity of the glucagon related peptide with respect to glucagon, GLP-1 or other glucagon-related peptide receptor is retained. In some embodiments, if the unalkylated peptide has glucagon agonist activity, then the alkylated peptide retains glucagon agonist activity is retained. In other embodiments, if the unalkylated peptide has glucagon antagonist activity, then the alkylated peptide retains glucagon antagonist activity. In some embodiments, if the unalkylated peptide has GLP-1 agonist activity, then the alkylated peptide retains GLP-1 agonist activity. Nonlimiting examples include alkylation at positions 5, 7, 10, 11, 12, 13, 14, 16, 17, 18, 19, 20, 21, 24, 27, 28, or 29 (according to the amino acid numbering of wild type glucagon). With regard to Class 1, Class 2, and Class 3 glucagon related peptides, alkylation can occur at positions 5, 7, 10, 11, 12, 13, 14, 16, 17, 18, 19, 20, 21, 24, 27, 28, 29, 30, 37, 38, 39, 40, 41, 42, or 43 (according to the amino acid numbering of wild type glucagon). The alkyl group can be covalently linked directly to an amino acid of the glucagon related peptide, or indirectly to an amino acid of the glucagon related peptide via a spacer, wherein the spacer is positioned between the amino acid of the glucagon related peptide and the alkyl group. Glucagon related peptides may be alkylated at the same amino acid position where a hydrophilic moiety is linked, or at a different amino acid position. Nonlimiting examples include alkylation at position 10 (according to the amino acid numbering of wild type glucagon) and pegylation at one or more positions in the C-terminal portion of the glucagon related peptide, e.g., position 24, 28 or 29 (according to the amino acid numbering of wild type glucagon), within a C-terminal extension, or at the C-terminus (e.g., through adding a C-terminal Cys).

In a specific aspect of the invention, the glucagon related peptide is modified to comprise an alkyl group by direct alkylation of an amine, hydroxyl, or thiol of a side chain of an amino acid of the glucagon related peptide. In some embodiments, the glucagon related peptide is directly alkylated through the side chain amine, hydroxyl, or thiol of an amino acid. In some embodiments, alkylation is at position 10, 20, 24, or 29 (according to the amino acid numbering of wild type glucagon). In this regard, the alkylated glucagon related peptide can comprise the amino acid sequence of SEQ ID NO: 701, or a modified amino acid sequence thereof comprising one or more of the amino acid modifications described herein, with at least one of the amino acids at positions 10, 20, 24, and 29 (according to the amino acid numbering of wild type glucagon) modified to any amino acid comprising a side chain amine, hydroxyl, or thiol. In some specific embodiments of the invention, the direct alkylation of the glucagon related peptide occurs through the side chain amine, hydroxyl, or thiol of the amino acid at position 10 (according to the amino acid numbering of wild type glucagon).

In some embodiments, the amino acid comprising a side chain amine is an amino acid of Formula I. In some exemplary embodiments, the amino acid of Formula I, is the amino acid wherein n is 4 (Lys) or n is 3 (Orn).

In other embodiments, the amino acid comprising a side chain hydroxyl is an amino acid of Formula II. In some exemplary embodiments, the amino acid of Formula II is the amino acid wherein n is 1 (Ser).

In yet other embodiments, the amino acid comprising a side chain thiol is an amino acid of Formula III. In some exemplary embodiments, the amino acid of Formula II is the amino acid wherein n is 1 (Cys).

In yet other embodiments, in which the glucagon related peptide is a Class 1, Class 2, or Class 3 glucagon related peptide, the amino acid comprising a side chain amine, hydroxyl, or thiol is a disubstituted amino acid comprising the same structure of Formula I, Formula II, or Formula III, except that the hydrogen bonded to the alpha carbon of the amino acid of Formula I, Formula II, or Formula III is replaced with a second side chain.

In some embodiments of the invention, the alkylated glucagon related peptide comprises a spacer between the peptide and the alkyl group. In some embodiments, the glucagon related peptide is covalently bound to the spacer, which is covalently bound to the alkyl group. In some exemplary embodiments, the glucagon related peptide is modified to comprise an alkyl group by alkylation of an amine, hydroxyl, or thiol of a spacer, which spacer is attached to a side chain of an amino acid at position 10, 20, 24, or 29 (according to the amino acid numbering of wild type glucagon) of the glucagon related peptide. The amino acid to which the spacer is attached can be any amino acid comprising a moiety which permits linkage to the spacer. With regard to Class 1, Class 2, and Class 3 glucagon related peptides, the amino acid to which the spacer is attached can be any amino acid (e.g., a singly α-substituted amino acid or an α,α-disubstituted amino acid) comprising a moiety which permits linkage to the spacer. For example, an amino acid comprising a side chain —NH$_2$, —OH, or —COOH (e.g., Lys, Orn, Ser, Asp, or Glu) is suitable. In this respect, the alkylated glucagon related peptide can comprise the amino acid sequence of SEQ ID NO: 701, or a modified amino acid sequence thereof comprising one or more of the amino acid modifications described herein, with at least one of the amino acids at positions 10, 20, 24, and 29 (according to the amino acid numbering of wild type glucagon) modified to any amino acid comprising a side chain amine, hydroxyl, or carboxylate.

In some embodiments, the spacer is an amino acid comprising a side chain amine, hydroxyl, or thiol or a dipeptide or tripeptide comprising an amino acid comprising a side chain amine, hydroxyl, or thiol. In some embodiments, the amino acid spacer is not γ-Glu. In some embodiments, the dipeptide spacer is not γ-Glu-γ-Glu.

When alkylation occurs through an amine group of the amino acid of the spacer the alkylation can occur through the alpha amine of the amino acid or a side chain amine. In the instance in which the alpha amine is alkylated, the spacer amino acid can be any amino acid. For example, the spacer amino acid can be a hydrophobic amino acid, e.g., Gly, Ala, Val, Leu, Ile, Trp, Met, Phe, Tyr. Alternatively, the spacer amino acid can be an acidic residue, e.g., Asp and Glu. In exemplary embodiments in which the glucagon related peptide is a Class 1, Class 2, or Class 3 glucagon related peptide, the spacer amino acid can be a hydrophobic amino acid, e.g., Gly, Ala, Val, Leu, Ile, Trp, Met, Phe, Tyr, 6-amino hexanoic acid, 5-aminovaleric acid, 7-aminoheptanoic acid, 8-aminooctanoic acid. Alternatively, the spacer amino acid attached to the Class 1, Class 2, or Class 3 glucagon related peptide can be an acidic residue, e.g., Asp and Glu, provided that the alkylation occurs on the alpha amine of the acidic residue. In the instance in which the side chain amine of the spacer amino acid is alkylated, the spacer amino acid is an amino acid comprising a side chain amine, e.g., an amino acid of Formula I (e.g., Lys or Orn). In this instance, it is possible for both the alpha amine and the side chain amine of the spacer amino acid to be alkylated, such that the glucagon peptide is dialkylated. Embodiments of the invention include such dialkylated molecules.

When alkylation occurs through a hydroxyl group of the amino acid of the spacer, the amino acid or one of the amino acids of the spacer can be an amino acid of Formula II. In a specific exemplary embodiment, the amino acid is Ser.

When alkylation occurs through a thiol group of the amino acid of the spacer, the amino acid or one of the amino acids of the spacer can be an amino acid of Formula III. In a specific exemplary embodiment, the amino acid is Cys.

In some embodiments, the spacer comprises a hydrophilic bifunctional spacer. In a specific embodiment, the spacer comprises an amino poly(alkyloxy)carboxylate. In this regard, the spacer can comprise, for example, $NH_2(CH_2CH_2O)_n(CH_2)_mCOOH$, wherein m is any integer from 1 to 6 and n is any integer from 2 to 12, such as, e.g., 8-amino-3,6-dioxaoctanoic acid, which is commercially available from Peptides International, Inc. (Louisville, Ky.).

In some embodiments in which the glucagon related peptide is a Class 1, Class 2, or Class 3 glucagon related peptide, the spacer is a hydrophilic bifunctional spacer. In certain embodiments, the hydrophilic bifunctional spacer attached to the Class 1, Class 2, or Class 3 glucagon related peptide comprises two or more reactive groups, e.g., an amine, a hydroxyl, a thiol, and a carboxyl group or any combinations thereof. In certain embodiments, the hydrophilic bifunctional spacer attached to the Class 1, Class 2, or Class 3 glucagon related peptide comprises a hydroxyl group and a carboxylate. In other embodiments, the hydrophilic bifunctional spacer attached to the Class 1, Class 2, or Class 3 glucagon related peptide comprises an amine group and a carboxylate.

In other embodiments, the hydrophilic bifunctional spacer attached to the Class 1, Class 2, or Class 3 glucagon related peptide comprises a thiol group and a carboxylate.

In some embodiments, the spacer attached to the Class 1, Class 2, or Class 3 glucagon related peptide is a hydrophobic bifunctional spacer. In certain embodiments, the hydrophobic bifunctional spacer attached to the Class 1, Class 2, or Class 3 glucagon related peptide comprises two or more reactive groups, e.g., an amine, a hydroxyl, a thiol, and a carboxyl group or any combinations thereof. In certain embodiments, the hydrophobic bifunctional spacer attached to the Class 1, Class 2, or Class 3 glucagon related peptide comprises a hydroxyl group and a carboxylate. In other embodiments, the hydropholic bifunctional spacer attached to the Class 1, Class 2, or Class 3 glucagon related peptide comprises an amine group and a carboxylate. In other embodiments, the hydropholic bifunctional spacer attached to the Class 1, Class 2, or Class 3 glucagon related peptide comprises a thiol group and a carboxylate. Suitable hydrophobic bifunctional spacers comprising a carboxylate and a hydroxyl group or a thiol group are known in the art and include, for example, 8-hydroxyoctanoic acid and 8-mercaptooctanoic acid.

The spacer (e.g., amino acid, dipeptide, tripeptide, hydrophilic bifunctional spacer, or hydrophobic bifunctional spacer) in specific embodiments in which the glucagon related peptide is a Class 1, Class 2, or Class 3 glucagon related peptide is 3 to 10 atoms (e.g., 6 to 10 atoms, (e.g., 6, 7, 8, 9, or 10 atoms)) in length. In more specific embodiments, the spacer attached to the Class 1, Class 2, or Class 3 glucagon related peptide is about 3 to 10 atoms (e.g., 6 to 10 atoms) in length and the alkyl is a C12 to C18 alkyl group, e.g., C14 alkyl group, C16 alkyl group, such that the total length of the spacer and alkyl group is 14 to 28 atoms, e.g., about 14, 15, 16, 17, 18, 19, 20, 21, 22, 23, 24, 25, 26, 27, or 28 atoms. In some embodiments in which the glucagon related peptide is a Class 1, Class 2, or Class 3 glucagon related peptide, the length of the spacer and alkyl is 17 to 28 (e.g., 19 to 26, 19 to 21) atoms.

In accordance with certain foregoing embodiments in which the glucagon related peptide is a Class 1, Class 2, or Class 3 glucagon related peptide, the bifunctional spacer can be a synthetic or non-naturally occurring amino acid comprising an amino acid backbone that is 3 to 10 atoms in length (e.g., 6-amino hexanoic acid, 5-aminovaleric acid, 7-aminoheptanoic acid, and 8-aminooctanoic acid). Alternatively, the spacer attached to the Class 1, Class 2, or Class 3 glucagon related peptide can be a dipeptide or tripeptide spacer having a peptide backbone that is 3 to 10 atoms (e.g., 6 to 10 atoms) in length. The dipeptide or tripeptide spacer attached to the Class 1, Class 2, or Class 3 glucagon related peptide can be composed of naturally-occurring and/or non-naturally occurring amino acids, including, for example, any of the amino acids taught herein. In some embodiments in which the glucagon related peptide is a Class 1, Class 2, or Class 3 glucagon related peptide, the spacer comprises an overall negative charge, e.g., comprises one or two negatively charged amino acids. In some embodiments in which the glucagon related peptide is a Class 1, Class 2, or Class 3 glucagon related peptide, the dipeptide spacer is selected from the group consisting of: Ala-Ala, β-Ala-β-Ala, Leu-Leu, Pro-Pro, γ-aminobutyric acid-γ-aminobutyric acid, and γ-Glu-γ-Glu. In some embodiments, the dipeptide spacer is not γ-Glu-γ-Glu.

Suitable methods of peptide alkylation via amines, hydroxyls, and thiols are known in the art. For example, a Williamson ether synthesis can be used to form an ether linkage between the glucagon related peptide and the alkyl group. Also, a nucleophilic substitution reaction of the peptide with an alkyl halide can result in any of an ether, thioether, or amino linkage.

The alkyl group of the alkylated glucagon related peptide can be of any size, e.g., any length carbon chain, and can be linear or branched. In some embodiments of the invention, the alkyl group is a C4 to C30 alkyl. For example, the alkyl group can be any of a C4 alkyl, C6 alkyl, C8 alkyl, C10 alkyl, C12 alkyl, C14 alkyl, C16 alkyl, C18 alkyl, C20 alkyl, C22 alkyl, C24 alkyl, C26 alkyl, C28 alkyl, or a C30 alkyl. In some embodiments, the alkyl group is a C8 to C20 alkyl, e.g., a C14 alkyl or a C16 alkyl.

In some specific embodiments, the alkyl group comprises a steroid moiety of a bile acid, e.g., cholic acid, chenodeoxycholic acid, deoxycholic acid, lithocholic acid, taurocholic acid, glycocholic acid, and cholesterol acid.

In some embodiments of the invention in which the glucagon related peptide is a Class 1, Class 2, or Class 3 glucagon related peptide, the glucagon related peptide is modified to comprise an alkyl group by reacting a nucleophilic, long chain alkane with the glucagon related peptide, wherein the glucagon related peptide comprises a leaving group suitable for nucleophilic substitution. In specific aspects in which the glucagon related peptide is a Class 1, Class 2, or Class 3 glucagon related peptide, the nucleophilic group of the long chain alkane comprises an amine, hydroxyl, or thiol group (e.g. octadecylamine, tetradecanol, and hexadecanethiol). The leaving group of the Class 1, Class 2, or Class 3 glucagon related peptide can be part of a side chain of an amino acid or can be part of the peptide backbone. Suitable leaving groups include, for example, N-hydroxysuccinimide, halogens, and sulfonate esters.

In certain embodiments, the Class 1, Class 2, or Class 3 glucagon related peptide is modified to comprise an alkyl group by reacting the nucleophilic, long chain alkane with a spacer which is attached to the glucagon related peptide, wherein the spacer comprises the leaving group. In specific aspects in which the glucagon related peptide is a Class 1, Class 2, or Class 3 glucagon related peptide, the long chain alkane comprises an amine, hydroxyl, or thiol group. In certain embodiments in which the glucagon related peptide is a Class 1, Class 2, or Class 3 glucagon related peptide, the spacer comprising the leaving group can be any spacer discussed herein, e.g., amino acids, dipeptides, tripeptides, hydrophilic bifunctional spacers and hydrophobic bifunctional spacers further comprising a suitable leaving group.

With regard to these aspects of the invention in which the glucagon related peptide is a Class 1, Class 2, or Class 3 glucagon related peptide and in which a long chain alkane is alkylated by the glucagon related peptide or the spacer, the long chain alkane may be of any size and can comprise any length of carbon chain. The long chain alkane can be linear or branched. In certain aspects, the long chain alkane is a C4 to C30 alkane. For example, the long chain alkane can be any of a C4 alkane, C6 alkane, C8 alkane, C10 alkane, C12 alkane, C14 alkane, C16 alkane, C18 alkane, C20 alkane, C22 alkane, C24 alkane, C26 alkane, C28 alkane, or a C30 alkane. In some embodiments in which the glucagon related peptide is a Class 1, Class 2, or Class 3 glucagon related peptide, the long chain alkane comprises a C8 to C20 alkane, e.g., a C14 alkane, C16 alkane, or a C18 alkane.

Also, in some embodiments in which the glucagon related peptide is a Class 1, Class 2, or Class 3 glucagon related peptide, alkylation can occur between the glucagon related peptide and a cholesterol moiety. For example, the hydroxyl group of cholesterol can displace a leaving group on the long chain alkane to form a cholesterol-glucagon peptide product.

The alkylated glucagon related peptides described herein can be further modified to comprise a hydrophilic moiety. In some specific embodiments the hydrophilic moiety can comprise a polyethylene glycol (PEG) chain. The incorporation of a hydrophilic moiety can be accomplished through any suitable means, such as any of the methods described herein. In this regard, the alkylated glucagon related peptide can comprise SEQ ID NO: 701, or a modified amino acid sequence thereof comprising one or more of the amino acid modifications described herein, in which at least one of the amino acids at position 10, 20, 24, and 29 (according to the amino acid numbering of wild type glucagon) comprise an alkyl group and at least one of the amino acids at position 16, 17, 21, 24, and 29, a position within a C-terminal extension or the C-terminal amino acid are modified to a Cys, Lys, Orn, homo-Cys, or Ac-Phe, and the side chain of the amino acid is covalently bonded to a hydrophilic moiety (e.g., PEG). In some embodiments, the alkyl group is attached to position 10 (according to the amino acid numbering of wild type glucagon), optionally via a spacer comprising Cys, Lys, Orn, homo-Cys, or Ac-Phe, and the hydrophilic moiety is incorporated at a Cys residue at position 24.

Alternatively, the alkylated glucagon related peptide can comprise a spacer, wherein the spacer is both alkylated and modified to comprise the hydrophilic moiety. Nonlimiting examples of suitable spacers include a spacer comprising one or more amino acids selected from the group consisting of Cys, Lys, Orn, homo-Cys, and Ac-Phe.

Stabilization of the Alpha-Helix Structure

In some embodiments, an intramolecular bridge is formed between two amino acid side chains to stabilize the three dimensional structure of the carboxy terminal portion (e.g., amino acids 12-29 (according to the amino acid numbering of wild type glucagon)) of the glucagon related peptide. The two amino acid side chains can be linked to one another through hydrogen-bonding, ionic interactions, such as the formation of salt bridges, or by covalent bonds.

In some embodiments, the intramolecular bridge is formed between two amino acids that are 3 amino acids apart, e.g., amino acids at positions i and i+4, wherein i is any integer between 12 and 25 (e.g., 12, 13, 14, 15, 16, 17, 18, 19, 20, 21, 22, 23, 24, and 25) according to the amino acid numbering of wild type glucagon. More particularly, the side chains of the amino acid pairs 12 and 16, 16 and 20, 20 and 24 or 24 and 28 (amino acid pairs in which i=12, 16, 20, or 24) according to the amino acid numbering of wild type glucagon are linked to one another and thus stabilize the glucagon alpha helix. Alternatively, i can be 17.

In some specific embodiments, wherein the amino acids at positions i and i+4 are joined by an intramolecular bridge, the size of the linker is about 8 atoms, or about 7-9 atoms.

In other embodiments, the intramolecular bridge is formed between two amino acids that are two amino acids apart, e.g., amino acids at positions j and j+3, wherein j is any integer between 12 and 26 (e.g., 12, 13, 14, 15, 16, 17, 18, 19, 20, 21, 22, 23, 24, 25, and 26) according to the amino acid numbering of wild type glucagon. In some specific embodiments, j is 17.

In some specific embodiments, wherein amino acids at positions j and j+3 are joined by an intramolecular bridge, the size of the linker is about 6 atoms, or about 5 to 7 atoms.

In yet other embodiments, the intramolecular bridge is formed between two amino acids that are 6 amino acids apart, e.g., amino acids at positions k and k+7, wherein k is any integer between 12 and 22 (e.g., 12, 13, 14, 15, 16, 17, 18, 19, 20, 21, and 22) according to the amino acid numbering of wild type glucagon. In some specific embodiments, k is 12, 13, or 17. In an exemplary embodiment, k is 17.

Examples of amino acid pairings that are capable of covalently bonding to form a six-atom linking bridge include Orn and Asp, Glu and an amino acid of Formula I, wherein n is 2, and homoglutamic acid and an amino acid of Formula I, wherein n is 1, wherein Formula I is:

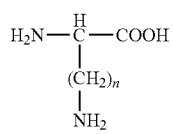

[Formula I]

wherein n = 1 to 4

Examples of amino acid pairing that are capable of covalently bonding to form a seven-atom linking bridge include Orn-Glu (lactam ring); Lys-Asp (lactam); or Homoser-Homoglu (lactone). Examples of amino acid pairings that may form an eight-atom linker include Lys-Glu (lactam); Homolys-Asp (lactam); Orn-Homoglu (lactam); 4-aminoPhe-Asp (lactam); or Tyr-Asp (lactone). Examples of amino acid pairings that may form a nine-atom linker include Homolys-Glu (lactam); Lys-Homoglu (lactam); 4-aminoPhe-Glu (lactam); or Tyr-Glu (lactone). Any of the side chains on these amino acids may additionally be substituted with additional chemical groups, so long as the three-dimensional structure of the alpha-helix is not disrupted. One of ordinary skill in the art can envision alternative pairings or alternative amino acid analogs, including chemically modified derivatives, that would create a stabilizing structure of similar size and desired effect. For example, a homocysteine-homocysteine disulfide bridge is 6 atoms in length and may be further modified to provide the desired effect. Even without covalent linkage, the amino acid pairings described above or similar pairings that one of ordinary skill in the art can envision may also provide added stability to the alpha-helix through non-covalent bonds, for example, through formation of salt bridges or hydrogen-bonding interactions.

The size of a lactam ring can vary depending on the length of the amino acid side chains, and in some embodiments the lactam is formed by linking the side chains of a lysine amino acid to a glutamic acid side chain. Further exemplary embodiments (according to the amino acid numbering of wild type glucagon) include the following pairings, optionally with a lactam bridge: Glu at position 12 with Lys at position 16; native Lys at position 12 with Glu at position 16; Glu at position 16 with Lys at position 20; Lys at position 16 with Glu at position 20; Glu at position 20 with Lys at position 24; Lys at position 20 with Glu at position 24; Glu at position 24 with Lys at position 28; Lys at position 24 with Glu at position 28. Alternatively, the order of the amide bond in the lactam ring can be reversed (e.g., a lactam ring can be formed between the side chains of a Lys12 and a Glu16 or alternatively between a Glu 12 and a Lys16).

Intramolecular bridges other than a lactam bridge can be used to stabilize the alpha helix of the glucagon related peptides. In some embodiments, the intramolecular bridge is a hydrophobic bridge. In this instance, the intramolecular bridge optionally is between the side chains of two amino acids that are part of the hydrophobic face of the alpha helix of the glucagon related peptide. For example, one of the amino acids joined by the hydrophobic bridge can be the amino acid at position 10, 14, and 18 (according to the amino acid numbering of wild type glucagon).

In one specific aspect, olefin metathesis is used to cross-link one or two turns of the alpha helix of the glucagon related peptide using an all-hydrocarbon cross-linking system. The glucagon related peptide in this instance can comprise α-methylated amino acids bearing olefinic side chains of varying length and configured with either R or S stereochemistry at the and i+4 or i+7 positions. For example, the olefinic side can comprise $(CH_2)n$, wherein n is any integer between 1 to 6. In some embodiments, n is 3 for a cross-link length of 8 atoms. Suitable methods of forming such intramolecular bridges are described in the art. See, for example, Schafmeister et al., *J. Am. Chem. Soc.* 122: 5891-5892 (2000) and Walensky et al., *Science* 305: 1466-1470 (2004). Alternatively, the glucagon peptide can comprise O-allyl Ser residues located on adjacent helical turns, which are bridged together via ruthenium-catalyzed ring closing metathesis. Such procedures of cross-linking are described in, for example, Blackwell et al., *Angew. Chem., Int. Ed.* 37: 3281-3284 (1998).

In another specific aspect, use of the unnatural thio-dialanine amino acid, lanthionine, which has been widely adopted as a peptidomimetic of cystine, is used to cross-link one turn of the alpha helix. Suitable methods of lanthionine-based cyclization are known in the art. See, for instance, Matteucci et al., *Tetrahedron Letters* 45: 1399-1401 (2004); Mayer et al., *J. Peptide Res.* 51: 432-436 (1998); Polinsky et al., *J. Med. Chem.* 35: 4185-4194 (1992); Osapay et al., *J. Med. Chem.* 40: 2241-2251 (1997); Fukase et al., *Bull. Chem. Soc. Jpn.* 65: 2227-2240 (1992); Harpp et al., *J. Org. Chem.* 36: 73-80 (1971); Goodman and Shao, *Pure Appl. Chem.* 68: 1303-1308 (1996); and Osapay and Goodman, *J. Chem. Soc. Chem. Commun.* 1599-1600 (1993).

In some embodiments, α,ω-diaminoalkane tethers, e.g., 1,4-diaminopropane and 1,5-diaminopentane) between two Glu residues at positions i and i+7 are used to stabilize the alpha helix of the glucagon peptide. Such tethers lead to the formation of a bridge 9-atoms or more in length, depending on the length of the diaminoalkane tether. Suitable methods of producing peptides cross-linked with such tethers are described in the art. See, for example, Phelan et al., *J. Am. Chem. Soc.* 119: 455-460 (1997).

In yet another embodiment of the invention, a disulfide bridge is used to cross-link one or two turns of the alpha helix of the glucagon related peptide. Alternatively, a modified disulfide bridge in which one or both sulfur atoms are replaced by a methylene group resulting in an isosteric macrocyclization is used to stabilize the alpha helix of the glucagon related peptide. Suitable methods of modifying peptides with disulfide bridges or sulfur-based cyclization are described in, for example, Jackson et al., *J. Am. Chem. Soc.* 113: 9391-9392 (1991) and Rudinger and Jost, *Experientia* 20: 570-571 (1964).

In yet another embodiment, the alpha helix of the glucagon related peptide is stabilized via the binding of metal atom by two His residues or a His and Cys pair positioned at i and i+4. The metal atom can be, for example, Ru(III), Cu(II), Zn(II), or Cd(II). Such methods of metal binding-based alpha helix stabilization are known in the art. See, for example, Andrews and Tabor, *Tetrahedron* 55: 11711-11743 (1999); Ghadiri et al., *J. Am. Chem. Soc.* 112: 1630-1632 (1990); and Ghadiri et al., *J. Am. Chem. Soc.* 119: 9063-9064 (1997).

The alpha helix of the glucagon related peptide can alternatively be stabilized through other means of peptide cyclizing, which means are reviewed in Davies, *J. Peptide. Sci.* 9: 471-501 (2003). The alpha helix can be stabilized via the formation of an amide bridge, thioether bridge, thioester bridge, urea bridge, carbamate bridge, sulfonamide bridge, and the like. For example, a thioester bridge can be formed between the C-terminus and the side chain of a Cys residue. Alternatively, a thioester can be formed via side chains of amino acids having a thiol (Cys) and a carboxylic acid (e.g., Asp, Glu). In another method, a cross-linking agent, such as a dicarboxylic acid, e.g. suberic acid (octanedioic acid), etc. can introduce a link between two functional groups of an amino acid side chain, such as a free amino, hydroxyl, thiol group, and combinations thereof.

In accordance with some embodiments, the alpha helix of the glucagon related peptide is stabilized through the incorporation of hydrophobic amino acids at positions i and i+4. For instance, i can be Tyr and i+4 can be either Val or Leu; i can be Phe and i+4 can be Cys or Met; I can be Cys and i+4 can be Met; or i can be Phe and i+4 can be Ile. It should be understood that, for purposes herein, the above amino acid pairings can be reversed, such that the indicated amino acid at position i could alternatively be located at i+4, while the i+4 amino acid can be located at the i position.

In accordance with other embodiments of the invention, wherein glucagon related peptide is a peptide having glucagon agonist activity, GIP agonist activity, glucagon antagonist and GLP-1 activity, the alpha helix is stabilized through incorporation (either by amino acid substitution or insertion) of one or more alpha helix-stabilizing amino acids at the C-terminal portion of the glucagon related peptide (around amino acids 12-29 according to the numbering of the amino acid numbering of wild type glucagon). In a specific embodiment, the alpha helix-stabilizing amino acid is an α,α-disubstituted amino acid, including, but not limited to any of amino iso-butyric acid (AIB), an amino acid disubstituted with the same or a different group selected from methyl, ethyl, propyl, and n-butyl, or with a cyclooctane or cycloheptane (e.g., 1-aminocyclooctane-1-carboxylic acid). In some embodiments, one, two, three, four or more of positions 16, 17, 18, 19, 20, 21, 24 or 29 of the glucagon related peptide is substituted with an α,α-disubstituted amino acid. In a specific embodiment, one, two, three or all of positions 16, 20, 21, and 24 are substituted with AIB.

Conjugates

The present disclosure also encompasses conjugates in which a glucagon related peptide (e.g. a Class 1 glucagon related peptide, Class 2 glucagon related peptide, Class 3 glucagon related peptide, Class 4 glucagon related peptide, or Class 5 glucagon related peptide), is linked, optionally via covalent bonding and optionally via a linker, to a conjugate moiety. Linkage can be accomplished by covalent chemical bonds, physical forces such electrostatic, hydrogen, ionic, van der Waals, or hydrophobic or hydrophilic interactions. A variety of non-covalent coupling systems may be used, including biotin-avidin, ligand/receptor, enzyme/substrate, nucleic acid/nucleic acid binding protein, lipid/lipid binding protein, cellular adhesion molecule partners; or any binding partners or fragments thereof which have affinity for each other.

The glucagon related peptide can be linked to conjugate moieties via direct covalent linkage by reacting targeted amino acid residues of the peptide with an organic derivatizing agent that is capable of reacting with selected side chains or the N- or C-terminal residues of these targeted amino acids. Reactive groups on the peptide or conjugate moiety include, e.g., an aldehyde, amino, ester, thiol, α-haloacetyl, maleimido or hydrazino group. Derivatizing agents include, for example, maleimidobenzoyl sulfosuccinimide ester (conjugation through cysteine residues), N-hydroxysuccinimide (through lysine residues), glutaraldehyde, succinic anhydride or other agents known in the art. Alternatively, the conjugate moieties can be linked to the peptide indirectly through intermediate carriers, such as polysaccharide or polypeptide carriers. Examples of polysaccharide carriers include aminodextran. Examples of suitable polypeptide carriers include polylysine, polyglutamic acid, polyaspartic acid, co-polymers thereof, and mixed polymers of these amino acids and others, e.g., serines, to confer desirable solubility properties on the resultant loaded carrier.

Cysteinyl residues most commonly are reacted with α-haloacetates (and corresponding amines), such as chloroacetic acid or chloroacetamide, to give carboxymethyl or carboxyamidomethyl derivatives. Cysteinyl residues also are derivatized by reaction with bromotrifluoroacetone, alpha-bromo-β-(5-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1 M sodium cacodylate at pH 6.0.

Lysinyl and amino-terminal residues are reacted with succinic or other carboxylic acid anhydrides. Derivatization with these agents has the effect of reversing the charge of the lysinyl residues. Other suitable reagents for derivatizing alpha-amino-containing residues include imidoesters such as methyl picolinimidate, pyridoxal phosphate, pyridoxal, chloroborohydride, trinitrobenzenesulfonic acid, O-methylisourea, 2,4-pentanedione, and transaminase-catalyzed reaction with glyoxylate.

Arginyl residues are modified by reaction with one or several conventional reagents, among them phenylglyoxal, 2,3-butanedione, 1,2-cyclohexanedione, and ninhydrin. Derivatization of arginine residues requires that the reaction be performed in alkaline conditions because of the high $pK_a$ of the guanidine functional group. Furthermore, these reagents may react with the groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively.

Carboxyl side groups (aspartyl or glutamyl) are selectively modified by reaction with carbodiimides (R—N=C=N—R'), where R and R' are different alkyl groups, such as 1-cyclohexyl-3-(2-morpholinyl-4-ethyl) carbodiimide or 1-ethyl-3-(4-azonia-4,4-dimethylpentyl) carbodiimide. Furthermore, aspartyl and glutamyl residues are converted to asparaginyl and glutaminyl residues by reaction with ammonium ions.

Other modifications include hydroxylation of proline and lysine, phosphorylation of hydroxyl groups of seryl or threonyl residues, methylation of the alpha-amino groups of lysine, arginine, and histidine side chains (T. E. Creighton, Proteins: Structure and Molecular Properties, W.H. Freeman & Co., San Francisco, pp. 79-86 (1983)), deamidation of asparagine or glutamine, acetylation of the N-terminal amine, and/or amidation or esterification of the C-terminal carboxylic acid group.

Another type of covalent modification involves chemically or enzymatically coupling glycosides to the peptide. Sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of tyrosine, or tryptophan, or (f) the amide group of glutamine.

These methods are described in WO87/05330 published 11 Sep. 1987, and in Aplin and Wriston, CRC Crit. Rev. Biochem., pp. 259-306 (1981).

Exemplary conjugate moieties that can be linked to any of the glucagon related peptides described herein include but are not limited to a heterologous peptide or polypeptide (including for example, a plasma protein), a targeting agent, an immunoglobulin or portion thereof (e.g. variable region, CDR, or Fc region), a diagnostic label such as a radioisotope, fluorophore or enzymatic label, a polymer including water soluble polymers, or other therapeutic or diagnostic agents. In some embodiments a conjugate is provided comprising a glucagon related peptide of the present invention and a plasma protein, wherein the plasma protein is selected from the group consisting of albumin, transferin, fibrinogen and globulins. In some embodiments the plasma protein moiety of the conjugate is albumin or transferin. In some embodiments, the linker comprises a chain of atoms from 1 to about 60, or 1 to 30 atoms or longer, 2 to 5 atoms, 2 to 10 atoms, 5 to 10 atoms, or 10 to 20 atoms long. In some embodiments, the chain atoms are all carbon atoms. In some embodiments, the chain atoms in the backbone of the linker are selected from the group consisting of C, O, N, and S. Chain atoms and linkers may be selected according to their expected solubility (hydrophilicity) so as to provide a more soluble conjugate. In some embodiments, the linker provides a functional group that is subject to cleavage by an enzyme or other catalyst or hydrolytic conditions found in the target tissue or organ or cell. In some embodiments, the length of the linker is long enough to reduce the potential for steric hindrance. If the linker is a covalent bond or a peptidyl bond and the conjugate is a polypeptide, the entire conjugate can be a fusion protein. Such peptidyl linkers may be any length. Exemplary linkers are from about 1 to 50 amino acids in length, 5 to 50, 3 to 5, 5 to 10, 5 to 15, or 10 to 30 amino acids in length. Such fusion proteins may alternatively be produced by recombinant genetic engineering methods known to one of ordinary skill in the art.

As noted above, in some embodiments, the glucagon related peptides are conjugated, e.g., fused to an immunoglobulin or portion thereof (e.g. variable region, CDR, or Fc region). Known types of immunoglobulins (Ig) include IgG, IgA, IgE, IgD or IgM. The Fc region is a C-terminal region of an Ig heavy chain, which is responsible for binding to Fc receptors that carry out activities such as recycling (which results in prolonged half-life), antibody dependent cell-mediated cytotoxicity (ADCC), and complement dependent cytotoxicity (CDC).

For example, according to some definitions the human IgG heavy chain Fc region stretches from Cys226 to the C-terminus of the heavy chain. The "hinge region" generally extends from Glu216 to Pro230 of human IgG1 (hinge regions of other IgG isotypes may be aligned with the IgG1 sequence by aligning the cysteines involved in cysteine bonding). The Fc region of an IgG includes two constant domains, CH2 and CH3. The CH2 domain of a human IgG Fc region usually extends from amino acids 231 to amino acid 341. The CH3 domain of a human IgG Fc region usually extends from amino acids 342 to 447. References made to amino acid numbering of immunoglobulins or immunoglobulin fragments, or regions, are all based on Kabat et al. 1991, Sequences of Proteins of Immunological Interest, U.S. Department of Public Health, Bethesda, Md. In a related embodiment, the Fc region may comprise one or more native or modified constant regions from an immunoglobulin heavy chain, other than CH1, for example, the CH2 and CH3 regions of IgG and IgA, or the CH3 and CH4 regions of IgE.

Suitable conjugate moieties include portions of immunoglobulin sequence that include the FcRn binding site. FcRn, a salvage receptor, is responsible for recycling immunoglobulins and returning them to circulation in blood. The region of the Fc portion of IgG that binds to the FcRn receptor has been described based on X-ray crystallography (Burmeister et al. 1994, Nature 372:379). The major contact area of the Fc with the FcRn is near the junction of the $CH_2$ and CH3 domains. Fc-FcRn contacts are all within a single Ig heavy chain. The major contact sites include amino acid residues 248, 250-257, 272, 285, 288, 290-291, 308-311, and 314 of the CH2 domain and amino acid residues 385-387, 428, and 433-436 of the CH3 domain.

Some conjugate moieties may or may not include FcγR binding site(s). FcγR are responsible for ADCC and CDC. Examples of positions within the Fc region that make a direct contact with FcγR are amino acids 234-239 (lower hinge region), amino acids 265-269 (B/C loop), amino acids 297-299 (C'/E loop), and amino acids 327-332 (F/G) loop (Sondermann et al., Nature 406: 267-273, 2000). The lower hinge region of IgE has also been implicated in the FcRI binding (Henry, et al., Biochemistry 36, 15568-15578, 1997). Residues involved in IgA receptor binding are described in Lewis et al., (J Immunol. 175:6694-701, 2005). Amino acid residues involved in IgE receptor binding are described in Sayers et al. (J Biol Chem. 279(34):35320-5, 2004).

Amino acid modifications may be made to the Fc region of an immunoglobulin. Such variant Fc regions comprise at least one amino acid modification in the CH3 domain of the Fc region (residues 342-447) and/or at least one amino acid modification in the CH2 domain of the Fc region (residues 231-341). Mutations believed to impart an increased affinity for FcRn include T256A, T307A, E380A, and N434A (Shields et al. 2001, J. Biol. Chem. 276:6591). Other mutations may reduce binding of the Fc region to FcγRI, FcγRIIA, FcγRIIB, and/or FcγRIIIA without significantly reducing affinity for FcRn. For example, substitution of the Asn at position 297 of the Fc region with Ala or another amino acid removes a highly conserved N-glycosylation site and may result in reduced immunogenicity with concomitant prolonged half-life of the Fc region, as well as reduced binding to FcγRs (Routledge et al. 1995, Transplantation 60:847; Friend et al. 1999, Transplantation 68:1632; Shields et al. 1995, J. Biol. Chem. 276:6591) Amino acid modifications at positions 233-236 of IgG1 have been made that reduce binding to FcγRs (Ward and Ghetie 1995, Therapeutic Immunology 2:77 and Armour et al. 1999, Eur. J. Immunol. 29:2613). Some exemplary amino acid substitutions are described in U.S. Pat. Nos. 7,355,008 and 7,381,408, each incorporated by reference herein in its entirety.

rPEG

In some embodiments, the conjugate of the invention comprises a glucagon superfamily peptide, including glucagon-related peptides, osteocalcin, as well as analogs, derivatives and conjugates of the foregoing, fused to an accessory peptide which is capable of forming an extended conformation similar to chemical PEG (e.g., a recombinant PEG (rPEG) molecule), such as those described in International Patent Application Publication No. WO2009/023270 and U.S. Patent Application Publication No. US2008/0286808. The rPEG molecule is not polyethylene glycol. The rPEG molecule in some aspects is a polypeptide comprising one or more of glycine, serine, glutamic acid, aspartic acid, alanine, or proline. In some aspects, the rPEG is a homopolymer, e.g., polyglycine, poly-serine, poly-glutamic acid, poly-aspartic acid, poly-alanine, or poly-proline. In other embodiments, the rPEG comprises two types of amino acids repeated, e.g., poly(Gly-Ser), poly(Gly-Glu), poly(Gly-Ala), poly(Gly-Asp), poly(Gly-Pro), poly(Ser-Glu), etc. In some aspects, the rPEG comprises three different types of amino acids, e.g., poly(Gly-Ser-Glu). In specific aspects, the rPEG increases the half-life of the glucagon superfamily peptide, or osteocalcin. In some aspects, the rPEG comprises a net positive or net negative charge. The rPEG in some aspects lacks secondary structure. In some embodiments, the rPEG is greater than or equal to 10 amino acids in length and in some embodiments is about 40 to about 50 amino acids in length. The accessory peptide in some aspects is fused to the N- or C-terminus of the peptide of the invention through a peptide bond or a proteinase cleavage site, or is inserted into the loops of the peptide of the invention. The rPEG in some aspects comprises an affinity tag or is linked to a PEG that is greater than 5 kDa. In some embodiments, the rPEG confers the peptide of the invention with an increased hydrodynamic radius, serum half-life, protease resistance, or solubility and in some aspects confers the peptide with decreased immunogenicity.

Fusion Peptides—C-Terminal Extension

In certain embodiments a glucagon related peptide may comprise a C-terminus or a C-terminal amino acid sequence including but not limited to: COOH, CONH$_2$, GPSSGAPPPS (SEQ ID NO: 710), GPSSGAPPPS-CONH$_2$ (SEQ ID NO: 711), a oxyntomodulin carboxy terminal extension, KRNRN-NIA (SEQ ID NO: 714) or KGKKNDWKHNITQ (SEQ ID NO: 713). For example, the terminal ten amino acids of Exendin-4 (i.e. the sequence of SEQ ID NO: 710 (GPSSGAPPPS)) are linked to the carboxy terminus of the Class 1 glucagon related peptide, Class 2 glucagon related peptide, Class 3 glucagon related peptide, Class 4 glucagon related peptide, or Class 5 glucagon related peptide of the present disclosure.

Another compound that induces weight loss is oxyntomodulin, a naturally occurring digestive hormone found in the small intestine (see Diabetes 2005; 54:2390-2395). Oxyntomodulin is a 37 amino acid peptide (SEQ ID NO: 706) that contains the 29 amino acid sequence of glucagon followed by an 8 amino acid carboxy terminal extension of SEQ ID NO: 714 (KRNRNNIA). Accordingly, in some embodiments prodrug derivatives of glucagon related peptides are provided that further comprise the carboxy terminal extension of the sequence of SEQ ID NO: 714 or a four amino acid extension having the sequence KRNR.

Glucagon Modification at Position 3

Glucagon related peptides of Classes 1 to 3 described herein may be modified at position 3 (according to the amino acid numbering of wild type glucagon) to maintain or increase activity at the glucagon receptor.

In some embodiments in which the glucagon related peptide is a Class 1, Class 2, or Class 3 glucagon related peptide, maintained or enhanced activity at the glucagon receptor may be achieved by modifying the Gln at position 3 with a glutamine analog. For example, a Class 1, Class 2, or Class 3 glucagon related peptide comprising a glutamine analog at position 3 may exhibit about 5%, about 10%, about 20%, about 50%, or about 85% or greater the activity of native glucagon (SEQ ID NO: 701) at the glucagon receptor. In some embodiments a Class 1, Class 2, or Class 3 glucagon related peptide comprising a glutamine analog at position 3 may exhibit about 20%, about 50%, about 75%, about 100%, about 200% or about 500% or greater the activity of a corresponding glucagon peptide having the same amino acid sequence as the peptide comprising the glutamine analog, except for the modified amino acid at position 3 at the glucagon receptor. In some embodiments, a Class 1, Class 2, or Class 3 glucagon related peptide comprising a glutamine analog at position 3 exhibits enhanced activity at the glucagon receptor, but the enhanced activity is no more than 1000%, 10,000%, 100,000%, or 1,000,000% of the activity of native glucagon or of a corresponding glucagon related peptide having the same amino acid sequence as the peptide comprising the glutamine analog, except for the modified amino acid at position 3.

In some embodiments, the glutamine analog is a naturally occurring or a non-naturally occurring amino acid comprising a side chain of Structure I, II or III:

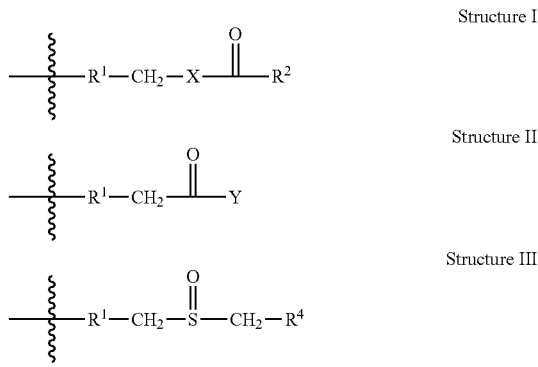

wherein $R^1$ is $C_{0-3}$ alkyl or $C_{0-3}$ heteroalkyl; $R^2$ is $NHR^4$ or $C_{1-3}$ alkyl; $R^3$ is $C_{1-3}$ alkyl; $R^4$ is H or $C_{1-3}$ alkyl; X is NH, O, or S; and Y is $NHR^4$, $SR^3$, or $OR^3$. In some embodiments, X is NH or Y is $NHR^4$. In some embodiments, $R^1$ is $C_{0-2}$ alkyl or $C_1$ heteroalkyl. In some embodiments, $R^2$ is $NHR^4$ or $C_1$ alkyl. In some embodiments, $R^4$ is H or $C^1$ alkyl. In exemplary embodiments in which the glucagon related peptide is a Class 1, Class 2, or Class 3 glucagon related peptide, an amino acid comprising a side chain of Structure I is provided where, $R^1$ is $CH_2$—S, X is NH, and $R^2$ is $CH_3$ (acetamidomethyl-cysteine, C(Acm)); $R^1$ is $CH_2$, X is NH, and $R^2$ is $CH_3$ (acetyl-diaminobutanoic acid, Dab(Ac)); $R^1$ is $C_0$ alkyl, X is NH, $R^2$ is $NHR^4$, and $R^4$ is H (carbamoyldiaminopropanoic acid, Dap(urea)); or $R^1$ is $CH_2$—$CH_2$, X is NH, and $R^2$ is $CH_3$ (acetylornithine, Orn(Ac)). In exemplary embodiments an amino acid comprising a side chain of Structure II is provided where, $R^1$ is $CH_2$, Y is $NHR^4$, and $R^4$ is $CH_3$ (methyl-glutamine, Q(Me)); In exemplary embodiments an amino acid comprising a side chain of Structure IIII is provided where, $R^1$ is $CH_2$ and $R^4$ is H (methionine-sulfoxide, M(O)); In specific embodiments, the amino acid at position 3 is substituted with Dab(Ac).

Dimers

With regard to the Class 1, Class 2, and Class 3 glucagon related peptides, the glucagon related peptide may be part of a dimer, trimer or higher order multimer comprising at least two, three, or more peptides bound via a linker, wherein at least one or both peptides is a glucagon related peptide. The dimer may be a homodimer or heterodimer. In some embodiments, the linker is selected from the group consisting of a bifunctional thiol crosslinker and a bi-functional amine crosslinker. In certain embodiments, the linker is PEG, e.g., a 5 kDa PEG, 20 kDa PEG. In some embodiments, the linker is a disulfide bond. For example, each monomer of the dimer may comprise a Cys residue (e.g., a terminal or internally positioned Cys) and the sulfur atom of each Cys residue participates in the formation of the disulfide bond. In some aspects of the invention, the monomers are connected via terminal amino acids (e.g., N-terminal or C-terminal), via internal amino acids, or via a terminal amino acid of at least one monomer and an internal amino acid of at least one other monomer. In specific aspects, the monomers are not connected via an N-terminal amino acid. In some aspects, the monomers of the multimer are attached together in a "tail-to-tail" orientation in which the C-terminal amino acids of each monomer are attached together. A conjugate moiety may be covalently linked to any of the glucagon related peptides described herein, including a dimer, trimer or higher order multimer.

Methods for Making Glucagon Related Peptides

The glucagon related peptides (and prodrugs) of this disclosed herein may be prepared by standard synthetic methods, recombinant DNA techniques, or any other methods of preparing peptides and fusion proteins. Although certain non-natural amino acids cannot be expressed by standard recombinant DNA techniques, techniques for their preparation are known in the art. Compounds of this invention that encompass non-peptide portions may be synthesized by standard organic chemistry reactions, in addition to standard peptide chemistry reactions when applicable.

Classes of glucagon related peptides are described in detail below. With respect to each of the sections of disclosure concerning class 1, 2, 3, 4 and 5 glucagon related peptides modifications are described with respect to the glucagon related peptide portion (O) of a prodrug compound detailed above. Thus, structural elements described with regard to a class of glucagon related peptides are structural elements of Q which is then further modified to generate a prodrug compound as described above.

Class 1 Glucagon Related Peptides

In certain embodiments, the glucagon related peptide is a Class 1 glucagon related peptide, which is described herein and in International Patent Application No. PCT US2009/47437 (filed on Jun. 16, 2009), International Patent Application Publication No. WO 2008/086086, published on Jul. 17, 2008, and U.S. Provisional Application No. 61/090,415, the contents of which are incorporated by reference in their entirety.

The biological sequences referenced in the following section (SEQ ID NOs: 801-915) relating to Class 1 glucagon related peptides correspond to SEQ ID NOs: 1-115 in International Patent Application No. PCT US2009/47437.

Activity

Class 1 glucagon peptides retain glucagon receptor activity relative to the native glucagon peptide (SEQ ID NO: 801). For example, the glucagon peptide can retain at least 10%, 20%, 30%, 40%, 50%, 60%, 70%, 75% activity, 80% activity, 85% activity, or 90% of the activity of native glucagon (calculated as the inverse ratio of EC50s for the glucagon peptide vs. glucagon, e.g., as measured by cAMP production using the assay generally described in Example 5). In some embodiments, the Class 1 glucagon related peptides have the same or greater activity (used synonymously with the term "potency" herein) than glucagon. In some embodiments, the glucagon peptides described herein exhibit no more than about 100%, 1000%, 10,000%, 100,000%, or 1,000,000% of the activity of native glucagon peptide.

Any of the Class 1 glucagon related peptides described herein may exhibit an EC50 at the human glucagon receptor of about 100 nM, 75 nM, 50 nM, 40 nM, 30 nM, 20 nM, 10 nM, 5 nM, 1 nM or less when tested for cAMP induction in HEK293 cells over-expressing glucagon receptor, e.g. using the assay of Example 5. Typically pegylated peptides will exhibit a higher EC50 compared to the unpegylated peptide. For example, the Class 1 glucagon related peptides described herein, when unpegylated, may exhibit activity at the glucagon receptor which is at least 20% (e.g., at least 30%, at least 40%, at least 50%, at least 60%, at least 75%, at least 80%, at least 90% at least 95%, at least 98%, at least 99%, 100%, 150%, 200%, 400%, 500% or more) of the activity of native glucagon (SEQ ID NO: 801) at the glucagon receptor. In certain embodiments, the Class 1 glucagon related peptides described herein exhibit the indicated % activity of native glucagon at the glucagon receptor, when lacking a hydrophilic moiety, but exhibit a decreased % activity of native glucagon at the glucagon receptor, when comprising a hydrophilic moiety. For example, the Class 1 glucagon related peptides described herein, when pegylated, may exhibit activity at the glucagon receptor which is at least 2% (e.g. at least 3%, at least 4%, at least 5%, at least 6%, at least 7%, at least 8%, at least 9%, or at least 10% of the activity of native glucagon. In some embodiments, the Class 1 glucagon related peptides described herein may exhibit any of the above indicated activities but no more than 1000%, 10,000%, 100,000%, or 1,000,000% of the activity of native glucagon at the glucagon receptor.

In some embodiments, the Class 1 glucagon related peptides exhibit less than about 5%, 4%, 3%, 2% or 1% of the activity of native GLP-1 at the GLP-1 receptor and/or a greater than about 5-fold, 10-fold, or 15-fold selectivity for glucagon receptor compared to GLP-1 receptor. For example, in some embodiments, the Class 1 glucagon related peptides exhibit less than 5% of the activity of native GLP-1 at the GLP-1 receptor and exhibit a greater than 5-fold selectivity for glucagon receptor compared to GLP-1 receptor.

Improved Solubility

Native glucagon exhibits poor solubility in aqueous solution, particularly at physiological pH, with a tendency to aggregate and precipitate over time. In contrast, the Class 1 glucagon related peptides in some embodiments exhibit at least 2-fold, 5-fold, or even higher solubility compared to native glucagon at a pH between 6 and 8, or between 6 and 9, for example, at pH 7 after 24 hours at 25° C.

Accordingly, in some embodiments, a Class 1 glucagon related peptide has been modified relative to the wild type peptide of His-Ser-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Asn-Thr (SEQ ID NO: 801) to improve the peptide's solubility in aqueous solutions, particularly at a pH ranging from about 5.5 to about 8.0, while retaining the native peptide's biological activity.

For example, the solubility of any of the Class 1 glucagon related peptides described herein can be further improved by attaching a hydrophilic moiety to the peptide. Introduction of such groups also increases duration of action, e.g. as measured by a prolonged half-life in circulation. Hydrophilic moieties are further described herein.

Modification with Charged Residues

In some embodiments, solubility is improved by adding charge to the Class 1 glucagon related peptide by the substitution of native non-charged amino acids with charged amino acids selected from the group consisting of lysine, arginine, histidine, aspartic acid and glutamic acid, or by the addition of charged amino acids to the amino or carboxy terminus of the peptide.

In accordance with some embodiments, the Class 1 glucagon related peptide has improved solubility due to the fact that the peptide is modified by amino acid substitutions and/or additions that introduce a charged amino acid into the C-terminal portion of the peptide, and in some embodiments at a position C-terminal to position 27 of SEQ ID NO: 801. Optionally, one, two or three charged amino acids may be introduced within the C-terminal portion, and in some embodiments C-terminal to position 27. In accordance with some embodiments, the native amino acid(s) at positions 28 and/or 29 are substituted with a charged amino acid, and/or one to three charged amino acids are added to the C-terminus of the peptide, e.g. after position 27, 28 or 29. In exemplary embodiments, one, two, three or all of the charged amino acids are negatively charged. In other embodiments, one, two, three or all of the charged amino acids are positively charged.

In specific exemplary embodiments, the Class 1 glucagon related peptide may comprise any one or two of the following modifications: substitution of N28 with E; substitution of N28 with D; substitution of T29 with D; substitution of T29 with E; insertion of E after position 27, 28 or 29; insertion of D after position 27, 28 or 29. For example, D28E29, E28E29, E29E30, E28E30, D28E30.

In accordance with one exemplary embodiment, the Class 1 glucagon related peptide comprises an amino acid sequence of SEQ ID NO: 811, or an analog thereof that contains 1 to 3 further amino acid modifications (described herein in reference to glucagon agonists) relative to native glucagon, or a glucagon agonist analog thereof SEQ ID NO: 811 represents a modified Class 1 glucagon related peptide, wherein the asparagine residue at position 28 of the native protein has been substituted with an aspartic acid. In another exemplary embodiment the Class 1 glucagon related peptide comprises an amino acid sequence of SEQ ID NO: 838, wherein the asparagine residue at position 28 of the native protein has been substituted with glutamic acid. Other exemplary embodiments include Class 1 glucagon related peptides of SEQ ID NOS: 824, 825, 826, 833, 835, 836 and 837.

Substituting the normally occurring amino acid at position 28 and/or 29 with charged amino acids, and/or the addition of one to two charged amino acids at the carboxy terminus of the Class 1 glucagon related peptide, enhances the solubility and stability of the glucagon peptides in aqueous solutions at physiologically relevant pHs (i.e., a pH of about 6.5 to about 7.5) by at least 5-fold and by as much as 30-fold. Accordingly, Class 1 glucagon peptides of some embodiments retain glucagon activity and exhibit at least 2-fold, 5-fold, 10-fold, 15-fold, 25-fold, 30-fold or greater solubility relative to native glucagon at a given pH between about 5.5 and 8, e.g., pH 7, when measured after 24 hours at 25° C.

Additional modifications, e.g. conservative substitutions, which modifications are further described herein, may be made to the Class 1 glucagon related peptide that still allow it to retain glucagon activity.

Improved Stability

Any of the Class 1 glucagon peptides may additionally exhibit improved stability and/or reduced degradation, for example, retaining at least 95% of the original peptide after 24 hours at 25° C. Any of the Class 1 glucagon related peptides disclosed herein may additionally exhibit improved stability at a pH within the range of 5.5 to 8, for example, retaining at least 75%, 80%, 90%, 95%, 96%, 97%, 98% or 99% of the original peptide after 24 hours at 25° C. In some embodiments, the Class 1 glucagon related peptides of the invention exhibit improved stability, such that at least 75% (e.g., at least 80%, at least 85%, at least 90%, at least 95%, more than 95%, up to 100%) of a concentration of the peptide or less than about 25% (e.g., less than 20%, less than 15%, less than 10%, less than 5%, 4%, 3%, 2%, 1%, down to 0%) of degraded peptide is detectable at 280 nm by an ultraviolet (UV) detector after about 1 or more weeks (e.g., about 2 weeks, about 4 weeks, about 1 month, about two months, about four months, about six months, about eight months, about ten months, about twelve months) in solution at a temperature of at least 20° C. (e.g., 21° C., 22° C., 23° C., 24° C., 25° C., 26° C., at least 27.5° C., at least 30° C., at least 35° C., at least 40° C., at least 50° C.) and less than 100° C., less than 85° C., less than 75° C., or less than 70° C. The Class 1 glucagon related peptides may include additional modifications that alter its pharmaceutical properties, e.g. increased potency, prolonged half-life in circulation, increased shelf-life, reduced precipitation or aggregation, and/or reduced degradation, e.g., reduced occurrence of cleavage or chemical modification after storage.

In yet further exemplary embodiments, any of the foregoing Class 1 glucagon related peptides can be further modified to improve stability by modifying the amino acid at position 15 of SEQ ID NO: 801 to reduce degradation of the peptide over time, especially in acidic or alkaline buffers. In exemplary embodiments, Asp at position 15 is substituted with a Glu, homo-Glu, cysteic acid, or homo-cysteic acid.

Alternatively, any of the Class 1 glucagon related peptides described herein can be further modified to improve stability by modifying the amino acid at position 16 of SEQ ID NO: 801. In exemplary embodiments, Ser at position 16 is substituted with Thr or AIB, or any of the amino acids substitutions described herein with regard to Class 1 glucagon related peptides which enhance potency at the glucagon receptor. Such modifications reduce cleavage of the peptide bond between Asp15-Ser16.

In some embodiments, any of the Class 1 glucagon related peptides described herein can be further modified to reduce degradation at various amino acid positions by modifying any one, two, three, or all four of positions 20, 21, 24, or 27. Exemplary embodiments include substitution of Gln at position 20 with Ser, Thr, Ala or AIB, substitution of Asp at position 21 with Glu, substitution of Gln at position 24 with Ala or AIB, substitution of Met at position 27 with Leu or Nle. Removal or substitution of methionine reduces degradation due to oxidation of the methionine. Removal or substitution of Gln or Asn reduces degradation due to deamidation of Gln or Asn. Removal or substitution of Asp reduces degradation that occurs through dehydration of Asp to form a cyclic succinimide intermediate followed by isomerization to iso-aspartate.

Enhanced Potency

In accordance with another embodiment, Class 1 glucagon related peptides are provided that have enhanced potency at the glucagon receptor, wherein the peptides comprise an amino acid modification at position 16 of native glucagon (SEQ ID NO: 801). By way of nonlimiting example, such enhanced potency can be provided by substituting the naturally occurring serine at position 16 with glutamic acid or with another negatively charged amino acid having a side chain with a length of 4 atoms, or alternatively with any one of glutamine, homoglutamic acid, or homocysteic acid, or a charged amino acid having a side chain containing at least one heteroatom, (e.g. N, O, S, P) and with a side chain length of about 4 (or 3-5) atoms. Substitution of serine at position 16 with glutamic acid enhances glucagon activity at least 2-fold, 4-fold, 5-fold and up to 10-fold greater at the glucagon receptor. In some embodiments, the Class 1 glucagon related peptide retains selectivity for the glucagon receptor relative to the GLP-1 receptors, e.g., at least 5-fold, 10-fold, or 15-fold selectivity.

DPP-IV Resistance

In some embodiments, the Class 1 glucagon peptides disclosed herein are further modified at position 1 or 2 to reduce susceptibility to cleavage by dipeptidyl peptidase IV. More particularly, in some embodiments, position 1 and/or position 2 of the Class 1 glucagon related peptide is substituted with the DPP-IV resistant amino acid(s) described herein. In some embodiments, position 2 of the analog peptide is substituted with an amino isobutyric acid. In some embodiments, position 2 of the analog peptide is substituted with an amino acid selected from the group consisting of D-serine, D-alanine, glycine, N-methyl serine, and C-amino butyric acid. In another embodiment, position 2 of the Class 1 glucagon related peptide is substituted with an amino acid selected from the group consisting of D-serine, glycine, and aminoisobutyric acid. In some embodiments, the amino acid at position 2 is not D-serine.

Reduction in glucagon activity upon modification of the amino acids at position 1 and/or position 2 of the glucagon peptide can be restored by stabilization of the alpha-helix structure in the C-terminal portion of the glucagon peptide (around amino acids 12-29). The alpha helix structure can be stabilized by, e.g., formation of a covalent or non-covalent intramolecular bridge (e.g., a lactam bridge between side chains of amino acids at positions "i" and "i+4", wherein i is an integer from 12 to 25), substitution and/or insertion of amino acids around positions 12-29 with an alpha helix-stabilizing amino acid (e.g., an α,α-disubstituted amino acid), as further described herein.

Modifications at Position 3

Glucagon receptor activity can be reduced by an amino acid modification at position 3 (according to the amino acid numbering of wild type glucagon), e.g. substitution of the naturally occurring glutamine at position 3, with an acidic, basic, or a hydrophobic amino acid. For example substitution at position 3 with glutamic acid, ornithine, or norleucine substantially reduces or destroys glucagon receptor activity.

Maintained or enhanced activity at the glucagon receptor may be achieved by modifying the Gln at position 3 with a glutamine analog as described herein. For example, glucagon agonists can comprise the amino acid sequence of SEQ ID NO: 863, SEQ ID NO: 869, SEQ ID NO: 870, SEQ ID NO: 871, SEQ ID NO: 872, SEQ ID NO: 873, and SEQ ID NO: 874.

Enhancing GLP-1 Activity with C-Terminal Amides and Esters

Enhanced activity at the GLP-1 receptor is provided by replacing the carboxylic acid of the C-terminal amino acid with a charge-neutral group, such as an amide or ester. Conversely, retaining the native carboxylic acid at the C-terminus of the peptide maintains the relatively greater selectivity of the Class 1 glucagon related peptide for the glucagon receptor vs. the GLP-1 receptor (e.g., greater than about 5, 6, 7, 8, 9, 10, 11, 12, 13, 14, 15, 16, 17, 18, 19, or 20-fold).

Further Modifications and Combinations

Additional modifications may be made to the Class 1 glucagon related peptide which may further increase solubility and/or stability and/or glucagon activity. The Class 1 glucagon related peptide may alternatively comprise other modifications that do not substantially affect solubility or stability, and that do not substantially decrease glucagon activity. In exemplary embodiments, the Class 1 glucagon related peptide may comprise a total of up to 11, or up to 12, or up to 13, or up to 14 amino acid modifications relative to the native glucagon sequence. For example, conservative or non-conservative substitutions, additions or deletions may be carried out at any of positions 2, 5, 7, 10, 11, 12, 13, 14, 17, 18, 19, 20, 21, 24, 27, 28 or 29.

Exemplary modifications of the Class 1 glucagon related peptide include but are not limited to:

(a) non-conservative substitutions, conservative substitutions, additions or deletions while retaining at least partial glucagon agonist activity, for example, conservative substitutions at one or more of positions 2, 5, 7, 10, 11, 12, 13, 14, 16, 17, 18, 19, 20, 21, 24, 27, 28 or 29, substitution of Tyr at position 10 with Val or Phe, substitution of Lys at position 12 with Arg, substitution of one or more of these positions with Ala;

(b) deletion of amino acids at positions 29 and/or 28, and optionally position 27, while retaining at least partial glucagon agonist activity;

(c) modification of the aspartic acid at position 15, for example, by substitution with glutamic acid, homoglutamic acid, cysteic acid or homocysteic acid, which may reduce degradation; or modification of the serine at position 16, for example, by substitution of threonine, AIB, glutamic acid or with another negatively charged amino acid having a side chain with a length of 4 atoms, or alternatively with any one of glutamine, homoglutamic acid, or homocysteic acid, which likewise may reduce degradation due to cleavage of the Asp 15-Ser16 bond;

(d) addition of a hydrophilic moiety such as the water soluble polymer polyethylene glycol, as described herein, e.g. at position 16, 17, 20, 21, 24, 29, 40 or at the C-terminal amino acid, which may increase solubility and/or half-life;

(e) modification of the methionine at position 27, for example, by substitution with leucine or norleucine, to reduce oxidative degradation;

(f) modification of the Gln at position 20 or 24, e.g. by substitution with Ser, Thr, Ala or AIB, to reduce degradation that occurs through deamidation of Gln (g) modification of Asp at position 21, e.g. by substitution with Glu, to reduce degradation that occurs through dehydration of Asp to form a cyclic succinimide intermediate followed by isomerization to iso-aspartate;

(h) modifications at position 1 or 2 as described herein that improve resistance to DPP-IV cleavage, optionally in combination with an intramolecular bridge such as a lactam bridge between positions "i" and "i+4", wherein i is an integer from 12 to 25, e.g., 12, 16, 20, 24;

(i) acylating or alkylating the glucagon peptide as described herein, which may increase the activity at the glucagon receptor and/or the GLP-1 receptor, increase half-life in circulation and/or extending the duration of action and/or delaying the onset of action, optionally combined with addition of a hydrophilic moiety, additionally or alternatively, optionally combined with a modification which selectively reduces activity at the GLP-1 peptide, e.g., a modification of the Thr at position 7, such as a substitution of the Thr at position 7 with an amino acid lacking a hydroxyl group, e.g., Abu or Ile; deleting amino acids C-terminal to the amino acid at position 27 (e.g., deleting one or both of the amino acids at positions 28 and 29, yielding a peptide 27 or 28 amino acids in length);

(j) C-terminal extensions as described herein;

(k) homodimerization or heterodimerization as described herein; and combinations of the (a) through (k).

In some embodiments, exemplary modifications of the Class 1 glucagon related peptide include at least one amino acid modification selected from Group A and one or more amino acid modifications selected from Group B and/or Group C, wherein Group A is:

substitution of Asn at position 28 with a charged amino acid;

substitution of Asn at position 28 with a charged amino acid selected from the group consisting of Lys, Arg, His, Asp, Glu, cysteic acid, and homocysteic acid;

substitution at position 28 with Asn, Asp, or Glu;

substitution at position 28 with Asp;

substitution at position 28 with Glu;

substitution of Thr at position 29 with a charged amino acid;
substitution of Thr at position 29 with a charged amino acid selected from the group consisting of Lys, Arg, His, Asp, Glu, cysteic acid, and homocysteic acid;
substitution at position 29 with Asp, Glu, or Lys;
substitution at position 29 with Glu;
insertion of 1-3 charged amino acids after position 29;
insertion after position 29 of Glu or Lys;
insertion after position 29 of Gly-Lys or Lys-Lys;
or combinations thereof;
wherein Group B is:
substitution of Asp at position 15 with Glu;
substitution of Ser at position 16 with Thr or AIB;
and wherein Group C is:
substitution of His at position 1 with a non-native amino acid that reduces susceptibility of the glucagon peptide to cleavage by dipeptidyl peptidase IV (DPP-IV),
substitution of Ser at position 2 with a non-native amino acid that reduces susceptibility of the glucagon peptide to cleavage by dipeptidyl peptidase IV (DPP-IV),
substitution of Lys at position 12 with Arg;
substitution of Gln at position 20 with Ser, Thr, Ala or AIB;
substitution of Asp at position 21 with Glu;
substitution of Gln at position 24 with Ser, Thr, Ala or AIB;
substitution of Met at position 27 with Leu or Nle;
deletion of amino acids at positions 27-29;
deletion of amino acids at positions 28-29;
deletion of the amino acid at positions 29;
or combinations thereof.

In exemplary embodiments, Lys at position 12 is substituted with Arg. In other exemplary embodiments amino acids at positions 29 and/or 28, and optionally at position 27, are deleted.

In some specific embodiments, the glucagon peptide comprises (a) an amino acid modification at position 1 and/or 2 that confers DPP-IV resistance, e.g., substitution with DMIA at position 1, or AIB at position 2, (b) an intramolecular bridge within positions 12-29, e.g. at positions 16 and 20, or one or more substitutions of the amino acids at positions 16, 20, 21, and 24 with an α,α disubstituted amino acid, optionally (c) linked to a hydrophilic moiety such as PEG, e.g., through Cys at position 24, 29 or at the C-terminal amino acid, optionally (d) an amino acid modification at position 27 that substitutes Met with, e.g., Nle, optionally (e) amino acid modifications at positions 20, 21 and 24 that reduce degradation, and optionally (f) linked to SEQ ID NO: 820. When the glucagon peptide is linked to SEQ ID NO: 820, the amino acid at position 29 in certain embodiments is Thr or Gly. In other specific embodiments, the glucagon peptide comprises (a) Asp28Glu29, or Glu28Glu29, or Glu29Glu30, or Glu28Glu30 or Asp28Glu30, and optionally (b) an amino acid modification at position 16 that substitutes Ser with, e.g. Thr or AIB, and optionally (c) an amino acid modification at position 27 that substitutes Met with, e.g., Nle, and optionally (d) amino acid modifications at positions 20, 21 and 24 that reduce degradation. In a specific embodiment, the glucagon peptide is T16, A20, E21, A24, Nle27, D28, E29.

In some embodiments, the Class 1 glucagon related peptide comprises the amino acid sequence:

X1-X2-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Z (SEQ ID NO: 839) with 1 to 3 amino acid modifications thereto, wherein X1 and/or X2 is a non-native amino acid that reduces susceptibility of (or increases resistance of) the glucagon peptide to cleavage by dipeptidyl peptidase IV (DPP-IV), wherein Z is selected from the group consisting of —COOH (the naturally occurring C-terminal carboxylate), -Asn-COOH, Asn-Thr-COOH, and Y—COOH, wherein Y is 1 to 2 amino acids, and wherein an intramolecular bridge, preferably a covalent bond, connects the side chains of an amino acid at position i and an amino acid at position i+4, wherein i is 12, 16, 20 or 24.

In some embodiments, the intramolecular bridge is a lactam bridge. In some embodiments, the amino acids at positions i and i+4 of SEQ ID NO: 839 are Lys and Glu, e.g., Glu16 and Lys20. In some embodiments, X1 is selected from the group consisting of: D-His, N-methyl-His, alpha-methyl-His, imidazole acetic acid, des-amino-His, hydroxyl-His, acetyl-His, homo-His, and alpha, alpha-dimethyl imidiazole acetic acid (DMIA). In other embodiments, X2 is selected from the group consisting of: D-Ser, D-Ala, Gly, N-methyl-Ser, Val, and alpha, amino isobutyric acid (AIB). In some embodiments, the glucagon peptide is covalently linked to a hydrophilic moiety at any of amino acid positions 16, 17, 20, 21, 24, 29, 40, within a C-terminal extension, or at the C-terminal amino acid. In exemplary embodiments, this hydrophilic moiety is covalently linked to a Lys, Cys, Orn, homocysteine, or acetyl-phenylalanine residue at any of these positions. Exemplary hydrophilic moieties include polyethylene glycol (PEG), for example, of a molecular weight of about 1,000 Daltons to about 40,000 Daltons, or about 20,000 Daltons to about 40,000 Daltons.

In other embodiments, the Class I glucagon related peptide comprises the amino acid sequence:

(SEQ ID NO: 839)
X1-X2-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Z, wherein X1 and/or X2 is a non-native amino acid that reduces susceptibility of (or increases resistance of) the glucagon peptide to cleavage by dipeptidyl peptidase IV (DPP-IV), wherein one, two, three, four or more of positions 16, 20, 21, and 24 of the glucagon peptide is substituted with an α,α-disubstituted amino acid, and wherein Z is selected from the group consisting of —COOH (the naturally occurring C-terminal carboxylate), -Asn-COOH, Asn-Thr-COOH, and Y—COOH, wherein Y is 1 to 2 amino acids.

Exemplary further amino acid modifications to the foregoing Class 1 glucagon related peptides or analogs include substitution of Thr at position 7 with an amino acid lacking a hydroxyl group, e.g., aminobutyric acid (Abu), Ile, optionally, in combination with substitution or addition of an amino acid comprising a side chain covalently attached (optionally, through a spacer) to an acyl or alkyl group, which acyl or alkyl group is non-native to a naturally-occurring amino acid, substitution of Lys at position 12 with Arg; substitution of Asp at position 15 with Glu; substitution of Ser at position 16 with Thr or AIB; substitution of Gln at position 20 with Ser, Thr, Ala or AIB; substitution of Asp at position 21 with Glu; substitution of Gln at position 24 with Ser, Thr, Ala or AIB; substitution of Met at position 27 with Leu or Nle; substitution of Asn at position 28 with a charged amino acid; substitution of Asn at position 28 with a charged amino acid selected from the group consisting of Lys, Arg, His, Asp, Glu, cysteic acid, and homocysteic acid; substitution at position 28 with Asn, Asp, or Glu; substitution at position 28 with Asp; substitution at position 28 with Glu; substitution of Thr at position 29 with a charged amino acid; substitution of Thr at position 29 with a charged amino acid selected from the group consisting of Lys, Arg, His, Asp, Glu, cysteic acid, and homocysteic acid; substitution at position 29 with Asp, Glu, or Lys; substitution at position 29 with Glu; insertion of 1-3 charged amino acids after position 29; insertion at position 30 (i.e., after position 29) of Glu or Lys; optionally with insertion at position 31 of Lys; addition of SEQ ID NO: 820 to the C-terminus, optionally, wherein the amino acid at position 29 is Thr or Gly; substitution or addition of an amino acid covalently attached to a hydrophilic moiety; or a combination thereof.

Any of the modifications described above in reference to Class 1 glucagon agonists which increase glucagon receptor activity, retain partial glucagon receptor activity, improve solubility, increase stability, or reduce degradation can be applied to Class 1 glucagon peptides individually or in combination. Thus, Class 1 glucagon related peptides can be prepared that retain at least 20% of the activity of native glucagon at the glucagon receptor, and which are soluble at a concentration of at least 1 mg/mL at a pH between 6 and 8 or between 6 and 9, (e.g. pH 7), and optionally retain at least 95% of the original peptide (e.g. 5% or less of the original peptide is degraded or cleaved) after 24 hours at 25° C. Alternatively, high potency Class 1 glucagon peptides can be prepared that exhibit at least about 100%, 125%, 150%, 175%, 200%, 250%, 300%, 350%, 400%, 450%, 500%, 600%, 700%, 800%, 900% or 10-fold or more of the activity of native glucagon at the glucagon receptor, and optionally are soluble at a concentration of at least 1 mg/mL at a pH between 6 and 8 or between 6 and 9, (e.g. pH 7), and optionally retains at least 95% of the original peptide (e.g. 5% or less of the original peptide is degraded or cleaved) after 24 hours at 25° C. In some embodiments, the Class 1 glucagon peptides described herein may exhibit at least any of the above indicated relative levels of activity at the glucagon receptor but no more than 10,000%, 100,000% or 1,000,000% of the activity of native glucagon at the glucagon receptor.

Examples of Embodiments of Class 1 Glucagon Related Peptides

In accordance with some embodiments the native glucagon peptide of SEQ ID NO: 801 is modified by the substitution of the native amino acid at position 28 and/or 29 with a negatively charged amino acid (e.g., aspartic acid or glutamic acid) and optionally the addition of a negatively charged amino acid (e.g., aspartic acid or glutamic acid) to the carboxy terminus of the peptide. In an alternative embodiment the native glucagon peptide of SEQ ID NO: 801 is modified by the substitution of the native amino acid at position 29 with a positively charged amino acid (e.g., lysine, arginine or histidine) and optionally the addition of one or two positively charged amino acid (e.g., lysine, arginine or histidine) on the carboxy terminus of the peptide. In accordance with some embodiments a glucagon analog having improved solubility and stability is provided wherein the analog comprises the amino acid sequence of SEQ ID NO: 834 with the proviso that at least one amino acids at position, 28, or 29 is substituted with an acidic amino acid and/or an additional acidic amino acid is added at the carboxy terminus of SEQ ID NO: 834. In some embodiments the acidic amino acids are independently selected from the group consisting of Asp, Glu, cysteic acid and homocysteic acid.

In accordance with some embodiments a glucagon agonist having improved solubility and stability is provided wherein the agonist comprises the amino acid sequence of SEQ ID NO: 833, wherein at least one of the amino acids at positions 27, 28 or 29 is substituted with a non-native amino acid residue (i.e. at least one amino acid present at position 27, 28 or 29 of the analog is an acid amino acid different from the amino acid present at the corresponding position in SEQ ID NO: 801). In accordance with some embodiments a glucagon agonist is provided comprising the sequence of SEQ ID NO: 833 with the proviso that when the amino acid at position 28 is asparagine and the amino acid at position 29 is threonine, the peptide further comprises one to two amino acids, independently selected from the group consisting of Lys, Arg, His, Asp or Glu, added to the carboxy terminus of the glucagon peptide.

It has been reported that certain positions of the native glucagon peptide can be modified while retaining at least some of the activity of the parent peptide. Accordingly, applicants anticipate that one or more of the amino acids located at positions at positions 2, 5, 7, 10, 11, 12, 13, 14, 16, 17, 18, 19, 20, 21, 24, 27, 28 or 29 of the peptide of SEQ ID NO: 811 can be substituted with an amino acid different from that present in the native glucagon peptide, and still retain the enhanced potency, physiological pH stability and biological activity of the parent glucagon peptide. For example, in accordance with some embodiments the methionine residue present at position 27 of the native peptide is changed to leucine or norleucine to prevent oxidative degradation of the peptide.

In some embodiments a glucagon analog of SEQ ID NO: 833 is provided wherein 1 to 6 amino acids, selected from positions 1, 2, 5, 7, 10, 11, 12, 13, 14, 16, 17, 18, 19, 20, 21 or 24 of the analog differ from the corresponding amino acid of SEQ ID NO: 801. In accordance with another embodiment a glucagon analog of SEQ ID NO: 833 is provided wherein 1 to 3 amino acids selected from positions 1, 2, 5, 7, 10, 11, 12, 13, 14, 16, 17, 18, 19, 20, 21 or 24 of the analog differ from the corresponding amino acid of SEQ ID NO: 801. In another embodiment, a glucagon analog of SEQ ID NO: 807, SEQ ID NO: 808 or SEQ ID NO: 834 is provided wherein 1 to 2 amino acids selected from positions 1, 2, 5, 7, 10, 11, 12, 13, 14, 16, 17, 18, 19, 20, 21 or 24 of the analog differ from the corresponding amino acid of SEQ ID NO: 801, and in a further embodiment those one to two differing amino acids represent conservative amino acid substitutions relative to the amino acid present in the native sequence (SEQ ID NO: 801). In some embodiments a glucagon peptide of SEQ ID NO: 811 or SEQ ID NO: 813 is provided wherein the glucagon peptide further comprises one, two or three amino acid substitutions at positions selected from positions 2, 5, 7, 10, 11, 12, 13, 14, 16, 17, 18, 19, 20, 21, 24, 27 or 29. In some embodiments the substitutions at positions 2, 5, 7, 10, 11, 12, 13, 14, 16, 17, 18, 19, 20, 27 or 29 are conservative amino acid substitutions.

In some embodiments a glucagon agonist is provided comprising an analog peptide of SEQ ID NO: 801 wherein the analog differs from SEQ ID NO: 801 by having an amino acid other than serine at position 2 and by having an acidic amino acid substituted for the native amino acid at position 28 or 29 or an acidic amino acid added to the carboxy terminus of the peptide of SEQ ID NO: 801. In some embodiments the acidic amino acid is aspartic acid or glutamic acid. In some embodiments a glucagon analog of SEQ ID NO: 809, SEQ ID NO: 812, SEQ ID NO: 813 or SEQ ID NO: 832 is provided wherein the analog differs from the parent molecule by a substitution at position 2. More particularly, position 2 of the analog peptide is substituted with an amino acid selected from the group consisting of D-serine, alanine, D-alanine, glycine, n-methyl serine and amino isobutyric acid.

some embodiments the glucagon peptide comprises the sequence of SEQ ID NO: 808, SEQ ID NO: 810 and SEQ ID NO: 811 further comprising an additional amino acid, selected from the group consisting of Asp and Glu, added to the C-terminus of the glucagon peptide. In some embodiments the glucagon peptide comprises the sequence of SEQ ID NO: 811 or SEQ ID NO: 813, and in a further embodiment the glucagon peptide comprises the sequence of SEQ ID NO: 811.

In accordance with some embodiments a glucagon agonist is provided comprising a modified glucagon peptide selected from the group consisting of:

(SEQ ID NO: 834)
NH$_2$-His-Ser-Gln-Gly-Thr-Phe-Thr-Ser-Asp-Tyr-Ser-Lys-Tyr-Leu-Xaa-Ser-Arg-Arg-Ala-Gln-Asp-Phe-Val-Gln-Trp-Leu-Xaa-Xaa-Xaa-R, (SEQ ID NO: 811)
NH$_2$-His-Ser-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Asp-Thr-R
and (SEQ ID NO: 813)
NH$_2$-His-Ser-Gln-Gly-Thr-Phe-Thr-Ser-Asp-Tyr-Ser-Xaa-Tyr-Leu-Glu-Ser-Arg-Arg-Ala-Gln-Asp-Phe-Val-Gln-Trp-Leu-Met-Asp-Thr-R In another embodiment a glucagon agonist is provided comprising an analog peptide of SEQ ID NO: 801 wherein the analog differs from SEQ ID NO: 801 by having an amino acid other than histidine at position 1 and by having an acidic amino acid substituted for the native amino acid at position 28 or 29 or an acidic amino acid added to the carboxy terminus of the peptide of SEQ ID NO: 801. In some embodiments the acidic amino acid is aspartic acid or glutamic acid. In some embodiments a glucagon analog of SEQ ID NO: 809, SEQ ID NO: 812, SEQ ID NO: 813 or SEQ ID NO: 832 is provided wherein the analog differs from the parent molecule by a substitution at position 1. More particularly, position 1 of the analog peptide is substituted with an amino acid selected from the group consisting of DMIA, D-histidine, desamino-histidine, hydroxyl-histidine, acetyl-histidine and homo-histidine.

In accordance with some embodiments the modified glucagon peptide comprises a sequence selected from the group consisting of SEQ ID NO: 809, SEQ ID NO: 812, SEQ ID NO: 813 and SEQ ID NO: 832. In a further embodiment a glucagon peptide is provided comprising a sequence of SEQ ID NO: 809, SEQ ID NO: 812, SEQ ID NO: 813 or SEQ ID NO: 832 further comprising one to two amino acids, added to the C-terminus of SEQ ID NO: 809, SEQ ID NO: 812, SEQ ID NO: 813 or SEQ ID NO: 832, wherein the additional amino acids are independently selected from the group consisting of Lys, Arg, His, Asp Glu, cysteic acid or homocysteic acid. In some embodiments the additional amino acids added to the carboxy terminus are selected from the group consisting of Lys, Arg, His, Asp or Glu or in a further embodiment the additional amino acids are Asp or Glu.

In another embodiment the glucagon peptide comprises the sequence of SEQ ID NO: 7 or a glucagon agonist analog thereof. In some embodiments the peptide comprising a sequence selected from the group consisting of SEQ ID NO: 808, SEQ ID NO: 810, SEQ ID NO: 811, SEQ ID NO: 812 and SEQ ID NO: 813. In another embodiment the peptide comprising a sequence selected from the group consisting of SEQ ID NO: 808, SEQ ID NO: 810 and SEQ ID NO: 811. In wherein Xaa at position 15 is Asp, Glu, cysteic acid, homoglutamic acid or homocysteic acid, the Xaa at position 28 is Asn or an acidic amino acid and the Xaa at position 29 is Thr or an acidic amino acid and R is an acidic amino acid, COOH or CONH$_2$, with the proviso that an acidic acid residue is present at one of positions 28, 29 or 30. In some embodiments R is COOH, and in another embodiment R is CONH$_2$.

The present disclosure also encompasses glucagon fusion peptides wherein a second peptide has been fused to the C-terminus of the glucagon peptide to enhance the stability and solubility of the glucagon peptide. More particularly, the fusion glucagon peptide may comprise a glucagon agonist analog comprising a glucagon peptide NH$_2$-His-Ser-Gln-Gly-Thr-Phe-Thr-Ser-Asp-Tyr-Ser-Lys-Tyr-Leu-Xaa-Ser-Arg-Arg-Ala-Gln-Asp-Phe-Val-Gln-Trp-Leu-Xaa-Xaa-Xaa-R (SEQ ID NO: 834), wherein R is an acidic amino acid or a bond and an amino acid sequence of SEQ ID NO: 820 (GPSSGAPPPS), SEQ ID NO: 821 (KRNRNNIA) or SEQ ID NO: 822 (KRNR) linked to the carboxy terminal amino acid of the glucagon peptide. In some embodiments the glucagon peptide is selected from the group consisting of SEQ ID NO: 833, SEQ ID NO: 807 or SEQ ID NO: 808 further comprising an amino acid sequence of SEQ ID NO: 820 (GPSSGAPPPS), SEQ ID NO: 821 (KRNRNNIA) or SEQ ID NO: 822 (KRNR) linked to the carboxy terminal amino acid of the glucagon peptide. In some embodiments the glucagon fusion peptide comprises SEQ ID NO: 802, SEQ ID NO: 803, SEQ ID NO: 804, SEQ ID NO: 805 and SEQ ID NO: 806 or a glucagon agonist analog thereof, further comprising an amino acid sequence of SEQ ID NO: 820 (GPSSGAPPPS), SEQ ID NO: 821 (KRNRNNIA) or SEQ ID NO: 822 (KRNR) linked to amino acid 29 of the glucagon peptide. In accordance with some embodiments the fusion peptide further comprises a PEG chain linked to an amino acid at position 16, 17, 21, 24, 29, within a C-terminal extension, or at the C-terminal amino acid, wherein the PEG chain is selected from the range of 500 to 40,000 Daltons. In some embodiments the amino acid sequence of SEQ ID NO: 820 (GPSSGAPPPS), SEQ ID NO: 821 (KRNRNNIA) or SEQ ID NO: 822 (KRNR) is bound to amino acid 29 of the glucagon peptide through a peptide bond. In some embodiments the glucagon peptide portion of the glucagon fusion peptide comprises a sequence selected from the group consisting of SEQ ID NO: 810, SEQ ID NO: 811 and SEQ ID NO: 813. In some embodiments the glucagon peptide portion of the glucagon fusion peptide comprises the sequence of SEQ ID NO: 811 or SEQ ID NO: 813, wherein a PEG chain is linked at position 21, 24, 29, within a C-terminal extension or at the C-terminal amino acid, respectively.

In another embodiment the glucagon peptide sequence of the fusion peptide comprises the sequence of SEQ ID NO: 811, further comprising an amino acid sequence of SEQ ID NO: 820 (GPSSGAPPPS), SEQ ID NO: 821 (KRNRNNIA) or SEQ ID NO: 822 (KRNR) linked to amino acid 29 of the glucagon peptide. In some embodiments the glucagon fusion peptide comprises a sequence selected from the group consisting of SEQ ID NO: 824, SEQ ID NO: 825 and SEQ ID NO: 826. Typically the fusion peptides of the present invention will have a C-terminal amino acid with the standard carboxylic acid group. However, analogs of those sequences wherein the C-terminal amino acid has an amide substituted for the carboxylic acid are also encompassed as embodiments. In accordance with some embodiments the fusion glucagon peptide comprises a glucagon agonist analog selected from the group consisting of SEQ ID NO: 810, SEQ ID NO: 811 and SEQ ID NO: 813, further comprising an amino acid sequence of SEQ ID NO: 823 (GPSSGAPPPS-CONH$_2$) linked to amino acid 29 of the glucagon peptide.

The glucagon agonists of the present invention can be further modified to improve the peptide's solubility and stability in aqueous solutions while retaining the biological activity of the glucagon peptide. In accordance with some embodiments, introduction of hydrophilic groups at one or more positions selected from positions 16, 17, 20, 21, 24 and 29 of the peptide of SEQ ID NO: 811, or a glucagon agonist analog thereof, are anticipated to improve the solubility and stability of the pH stabilize glucagon analog. More particularly, in some embodiments the glucagon peptide of SEQ ID NO: 810, SEQ ID NO: 811, SEQ ID NO: 813, or SEQ ID NO: 832 is modified to comprise one or more hydrophilic groups covalently linked to the side chains of amino acids present at positions 21 and 24 of the glucagon peptide.

In accordance with some embodiments, the glucagon peptide of SEQ ID NO: 811 is modified to contain one or more amino acid substitution at positions 16, 17, 20, 21, 24 and/or 29, wherein the native amino acid is substituted with an amino acid having a side chain suitable for crosslinking with hydrophilic moieties, including for example, PEG. The native peptide can be substituted with a naturally occurring amino acid or a synthetic (non-naturally occurring) amino acid. Synthetic or non-naturally occurring amino acids refer to amino acids that do not naturally occur in vivo but which, nevertheless, can be incorporated into the peptide structures described herein.

In some embodiments, a glucagon agonist of SEQ ID NO: 810, SEQ ID NO: 811 or SEQ ID NO: 813 is provided wherein the native glucagon peptide sequence has been modified to contain a naturally occurring or synthetic amino acid in at least one of positions 16, 17, 21, 24, 29, within a C-terminal extension or at the C-terminal amino acid of the native sequence, wherein the amino acid substitute further comprises a hydrophilic moiety. In some embodiments the substitution is at position 21 or 24, and in a further embodiment the hydrophilic moiety is a PEG chain. In some embodiments the glucagon peptide of SEQ ID NO: 811 is substituted with at least one cysteine residue, wherein the side chain of the cysteine residue is further modified with a thiol reactive reagent, including for example, maleimido, vinyl sulfone, 2-pyridylthio, haloalkyl, and haloacyl. These thiol reactive reagents may contain carboxy, keto, hydroxyl, and ether groups as well as other hydrophilic moieties such as polyethylene glycol units. In an alternative embodiment, the native glucagon peptide is substituted with lysine, and the side chain of the substituting lysine residue is further modified using amine reactive reagents such as active esters (succinimido, anhydride, etc) of carboxylic acids or aldehydes of hydrophilic moieties such as polyethylene glycol. In some embodiments the glucagon peptide is selected form the group consisting of SEQ ID NO: 814, SEQ ID NO: 815, SEQ ID NO: 816, SEQ ID NO: 817, SEQ ID NO: 818 and SEQ ID NO: 819.

In accordance with some embodiments the pegylated glucagon peptide comprises two or more polyethylene glycol chains covalently bound to the glucagon peptide wherein the total molecular weight of the glucagon chains is about 1,000 to about 5,000 Daltons. In some embodiments the pegylated glucagon agonist comprises a peptide of SEQ ID NO: 806, wherein a PEG chain is covalently linked to the amino acid residue at position 21 and at position 24, and wherein the combined molecular weight of the two PEG chains is about 1,000 to about 5,000 Daltons. In another embodiment the pegylated glucagon agonist comprises a peptide of SEQ ID NO: 806, wherein a PEG chain is covalently linked to the amino acid residue at position 21 and at position 24, and wherein the combined molecular weight of the two PEG chains is about 5,000 to about 20,000 Daltons.

The polyethylene glycol chain may be in the form of a straight chain or it may be branched. In accordance with some embodiments the polyethylene glycol chain has an average molecular weight selected from the range of about 500 to about 40,000 Daltons. In some embodiments the polyethylene glycol chain has a molecular weight selected from the range of about 500 to about 5,000 Daltons. In another embodiment the polyethylene glycol chain has a molecular weight of about 20,000 to about 40,000 Daltons.

Any of the glucagon peptides described above may be further modified to include a covalent or non-covalent intramolecular bridge or an alpha helix-stabilizing amino acid within the C-terminal portion of the glucagon peptide (amino acid positions 12-29). In accordance with some embodiments, the glucagon peptide comprises any one or more of the modifications discussed above in addition to an amino acid substitution at positions 16, 20, 21, or 24 (or a combination thereof) with an α,α-disubstituted amino acid, e.g., AIB. In accordance with another embodiment, the glucagon peptide comprises any one or more modifications discussed above in addition to an intramolecular bridge, e.g., a lactam, between the side chains of the amino acids at positions 16 and 20 of the glucagon peptide.

In accordance with some embodiments, the glucagon peptide comprises the amino acid sequence of SEQ ID NO: 877, wherein the Xaa at position 3 is an amino acid comprising a side chain of Structure I, II, or III:

Structure I

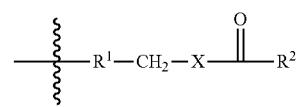

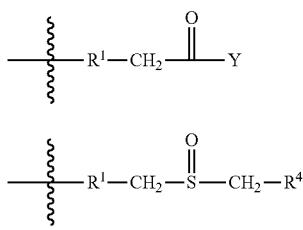

Structure II

Structure III wherein $R^1$ is $C_{0-3}$ alkyl or $C_{0-3}$ heteroalkyl; $R^2$ is $NHR^4$ or $C_{1-3}$ alkyl; $R^3$ is $C_{1-3}$ alkyl; $R^4$ is H or $C_{1-3}$ alkyl; X is NH, O, or S; and Y is $NHR^4$, $SR^3$, or $OR^3$. In some embodiments, X is NH or Y is $NHR^4$. In some embodiments, $R^1$ is $C_{0-2}$ alkyl or $C_1$ heteroalkyl. In some embodiments, $R^2$ is $NHR^4$ or $C_1$ alkyl. In some embodiments, $R^4$ is H or $C^1$ alkyl. In exemplary embodiments an amino acid comprising a side chain of Structure I is provided wherein, $R^1$ is $CH_2$—S, X is NH, and $R^2$ is $CH_3$ (acetamidomethyl-cysteine, C(Acm)); $R^1$ is $CH_2$, X is NH, and $R^2$ is $CH_3$ (acetyldiaminobutanoic acid, Dab(Ac)); $R^1$ is $C_0$ alkyl, X is NH, $R^2$ is $NHR^4$, and $R^4$ is H (carbamoyl-diaminopropanoic acid, Dap(urea)); or $R^1$ is $CH_2$—$CH_2$, X is NH, and $R^2$ is $CH_3$ (acetylornithine, Orn(Ac)). In exemplary embodiments an amino acid comprising a side chain of Structure II is provided, wherein $R^1$ is $CH_2$, Y is $NHR^4$, and $R^4$ is $CH_3$ (methylglutamine, Q(Me)); In exemplary embodiments an amino acid comprising a side chain of Structure III is provided wherein, $R^1$ is $CH_2$ and $R^4$ is H (methionine-sulfoxide, M(O)); In specific embodiments, the amino acid at position 3 is substituted with Dab(Ac). For example, glucagon agonists can comprise the amino acid sequence of SEQ ID NO: 863, SEQ ID NO: 869, SEQ ID NO: 871, SEQ ID NO: 872, SEQ ID NO: 873, and SEQ ID NO: 874.

In certain embodiments, the glucagon peptide is an analog of the glucagon peptide of SEQ ID NO: 877. In specific aspects, the analog comprises any of the amino acid modifications described herein, including, but not limited to: a substitution of Asn at position 28 with a charged amino acid; a substitution of Asn at position 28 with a charged amino acid selected from the group consisting of Lys, Arg, His, Asp, Glu, cysteic acid, and homocysteic acid; a substitution at position 28 with Asn, Asp, or Glu; a substitution at position 28 with Asp; a substitution at position 28 with Glu; a substitution of Thr at position 29 with a charged amino acid; a substitution of Thr at position 29 with a charged amino acid selected from the group consisting of Lys, Arg, His, Asp, Glu, cysteic acid, and homocysteic acid; a substitution at position 29 with Asp, Glu, or Lys; a substitution at position 29 with Glu; a insertion of 1-3 charged amino acids after position 29; an insertion after position 29 of Glu or Lys; an insertion after position 29 of Gly-Lys or Lys-Lys; and a combination thereof.

In certain embodiments, the analog of the glucagon peptide of SEQ ID NO: 877 comprises an α,α-disubstituted amino acid, such as AIB, at one, two, three, or all of positions 16, 20, 21, and 24.

In certain embodiments, the analog of the glucagon peptide of SEQ ID NO: 877 comprises one or more of the following: substitution of His at position 1 with a non-native amino acid that reduces susceptibility of the glucagon peptide to cleavage by dipeptidyl peptidase IV (DPP-IV), substitution of Ser at position 2 with a non-native amino acid that reduces susceptibility of the glucagon peptide to cleavage by dipeptidyl peptidase IV (DPP-IV), substitution of Thr at position 7 with an amino acid lacking a hydroxyl group, e.g., Abu or Ile; substitution of Tyr at position 10 with Phe or Val; substitution of Lys at position 12 with Arg; substitution of Asp at position 15 with Glu, substitution of Ser at position 16 with Thr or AIB; substitution of Gln at position 20 with Ala or AIB; substitution of Asp at position 21 with Glu; substitution of Gln at position 24 with Ala or AIB; substitution of Met at position 27 with Leu or Nle; deletion of amino acids at positions 27-29; deletion of amino acids at positions 28-29; deletion of the amino acid at positions 29; addition of the amino acid sequence of SEQ ID NO: 820 to the C-terminus, wherein the amino acid at position 29 is Thr or Gly, or a combination thereof.

In accordance with specific embodiments, the glucagon peptide comprises the amino acid sequence of any of SEQ ID NOs: 862-867 and 869-874.

In certain embodiments, the analog of the glucagon peptide comprising SEQ ID NO: 877 comprises a hydrophilic moiety, e.g., PEG, covalently linked to the amino acid at any of positions 16, 17, 20, 21, 24, and 29 or at the C-terminal amino acid.

In certain embodiments, the analog of the glucagon peptide comprising SEQ ID NO: 877 comprises an amino acid comprising a side chain covalently attached, optionally, through a spacer, to an acyl group or an alkyl group, which acyl group or alkyl group is non-native to a naturally-occurring amino acid. The acyl group in some embodiments is a C4 to C30 fatty acyl group. In other embodiments, the alkyl group is a C4 to C30 alkyl. In specific aspects, the acyl group or alkyl group is covalently attached to the side chain of the amino acid at position 10. In some embodiments, the amino acid at position 7 is Ile or Abu.

The glucagon agonist may be a peptide comprising the amino acid sequence of any of the SEQ ID NOs: 801-919, optionally with up to 1, 2, 3, 4, or 5 further modifications that retain glucagon agonist activity. In certain embodiments, the glucagon agonist comprises the amino acids of any of SEQ ID NOs: 859-919.

Class 2 Glucagon Related Peptides

In certain embodiments, the glucagon related peptide is a Class 2 glucagon related peptide, which is described herein and in International Patent Application No. PCT US2009/47447 (filed on Jun. 16, 2009), U.S. Provisional Application No. 61/090,448, and U.S. Application No. 61/151,349, the contents of which are incorporated by reference in their entirety.

The biological sequences referenced in the following section (SEQ ID NOs: 1001-1262) relating to Class 2 glucagon related peptides correspond to SEQ ID NOs: 1-262 in International Patent Application No. PCT US2009/47447.

Activity

Native glucagon does not activate the GIP receptor, and normally has about 1% of the activity of native-GLP-1 at the GLP-1 receptor. Modifications to the native glucagon sequence described herein produce Class 2 glucagon related peptides that can exhibit potent glucagon activity equivalent to or better than the activity of native glucagon (SEQ ID NO: 1001), potent GIP activity equivalent to or better than the activity of native GIP (SEQ ID NO: 1004), and/or potent GLP-1 activity equivalent to or better than the activity of native GLP-1. In this regard, the Class 2 glucagon related peptide may be one of a glucagon/GIP co-agonist, glucagon/GIP/GLP-1 tri-agonist, GIP/GLP-1 co-agonist, or a GIP agonist glucagon peptide, as further described herein.

In some embodiments, the Class 2 glucagon related peptides described herein exhibit an EC50 for GIP receptor activation activity of about 100 nM or less, or about 75, 50, 25, 10, 8, 6, 5, 4, 3, 2 or 1 nM or less. In some embodiments, the Class 2 glucagon related peptides exhibit an EC50 for glucagon receptor activation of about 100 nM or less, or about 75, 50, 25, 10, 8, 6, 5, 4, 3, 2 or 1 nM or less. In some embodiments, the Class 2 glucagon related peptides exhibit an EC50 for GLP-1 receptor activation of about 100 nM or less, or about 75, 50, 25, 10, 8, 6, 5, 4, 3, 2 or 1 nM or less. Receptor activation can be measured by in vitro assays measuring cAMP induction in HEK293 cells over-expressing the receptor, e.g. assaying HEK293 cells co-transfected with DNA encoding the receptor and a luciferase gene linked to cAMP responsive element as described in Example 5.

In some embodiments, Class 2 glucagon related peptides exhibit at least about 0.1%, 0.2%, 0.3%, 0.4%, 0.5%, 0.6%, 0.7%, 0.8%, 0.9%, 1%, 5%, 10%, 20%, 30%, 40%, 50%, 60%, 75%, 100%, 125%, 150%, 175% or 200% or higher activity at the GIP receptor relative to native GIP (GIP potency). In some embodiments, the glucagon peptides described herein exhibit no more than 1000%, 10,000%, 100,000%, or 1,000,000% activity at the GIP receptor relative to native GIP. In some embodiments, Class 2 glucagon related peptides exhibit at least about 1%, 5%, 10%, 20%, 30%, 40%, 50%, 60%, 75%, 100%, 125%, 150%, 175%, 200%, 250%, 300%, 350%, 400%, 450%, or 500% or higher activity at the glucagon receptor relative to native glucagon (glucagon potency). In some embodiments, the glucagon peptides described herein exhibit no more than 1000%, 10,000%, 100,000%, or 1,000,000% activity at the glucagon receptor relative to native glucagon. In some embodiments, Class 2 glucagon related peptides exhibit at least about 0.1%, 0.2%, 0.3%, 0.4%, 0.5%, 0.6%, 0.7%, 0.8%, 0.9%, 1%, 5%, 10%, 20%, 30%, 40%, 50%, 60%, 75%, 100%, 125%, 150%, 175% or 200% or higher activity at the GLP-1 receptor relative to native GLP-1 (GLP-1 potency). In some embodiments, the glucagon peptides described herein exhibit no more than 1000%, 10,000%, 100,000%, or 1,000,000% activity at the GLP-1 receptor relative to native GLP-1. A Class 2 glucagon related peptide's activity at a receptor relative to a native ligand of the receptor is calculated as the inverse ratio of EC50s for the Class 2 glucagon related peptide vs. the native ligand.

In some embodiments, Class 2 glucagon related peptides exhibit activity at both the glucagon receptor and the GIP receptor ("glucagon/GIP co-agonists"). These Class 2 glucagon related peptides have lost native glucagon's selectivity for glucagon receptor compared to GIP receptor. In some embodiments, the EC50 of the Class 2 glucagon related peptide at the GIP receptor is less than about 50-fold, 40-fold, 30-fold or 20-fold different (higher or lower) from its EC50 at the glucagon receptor. In some embodiments, the GIP potency of the Class 2 glucagon related peptide is less than about 500-, 450-, 400-, 350-, 300-, 250-, 200-, 150-, 100-, 75-, 50-, 25-, 20-, 15-, 10-, or 5-fold different (higher or lower) from its glucagon potency. In some embodiments, the ratio of the EC50 of the Class 2 glucagon related peptide at the GIP receptor divided by the EC50 of the Class 2 glucagon related peptide at the glucagon receptor is less than about 100, 75, 60, 50, 40, 30, 20, 15, 10, or 5. In some embodiments, the ratio of the EC50 at the GIP receptor divided by the EC50 at the glucagon receptor is about 1 or less than about 1 (e.g., about 0.01, 0.013, 0.0167, 0.02, 0.025, 0.03, 0.05, 0.067, 0.1, 0.2). In some embodiments, the ratio of the GIP potency of the Class 2 glucagon related peptide compared to the glucagon potency of the Class 2 glucagon related peptide is less than about 500, 450, 400, 350, 300, 250, 200, 150, 100, 75, 60, 50, 40, 30, 20, 15, 10, or 5. In some embodiments, the ratio of the potency at the GIP receptor divided by the potency at the glucagon receptor is about 1 or less than about 1 (e.g., about 0.01, 0.013, 0.0167, 0.02, 0.025, 0.03, 0.05, 0.067, 0.1, 0.2).

In some embodiments, GLP-1 activity have been significantly reduced or destroyed, e.g., by an amino acid modification at position 7, a deletion of the amino acid(s) C-terminal to the amino acid at position 27 or 28, yielding a 27- or 28-amino acid peptide, or a combination thereof.

In another aspect, Class 2 glucagon related peptides exhibit activity at the glucagon, GIP and GLP-1 receptors ("glucagon/GIP/GLP-1 tri-agonists"). These Class 2 glucagon related peptides have lost native glucagon's selectivity for the glucagon receptor compared to both the GLP-1 and GIP receptors. In some embodiments, the EC50 of the Class 2 glucagon related peptide at the GIP receptor is less than about 50-fold, 40-fold, 30-fold or 20-fold different (higher or lower) from its respective EC50s at the glucagon and GLP-1 receptors. In some embodiments, the GIP potency of the Class 2 glucagon related peptide is less than about 500-, 450-, 400-, 350-, 300-, 250-, 200-, 150-, 100-, 75-, 50-, 25-, 20-, 15-, 10-, or 5-fold different (higher or lower) from its glucagon and GLP-1 potencies. In some embodiments, the ratio of the EC50 of the tri-agonist at the GIP receptor divided by the EC50 of the tri-agonist at the GLP-1 receptor is less than about 100, 75, 60, 50, 40, 30, 20, 15, 10, or 5. In some embodiments, the ratio of the EC50 at the GIP receptor divided by the EC50 at the GLP-1 receptor is about 1 or less than about 1 (e.g., about 0.01, 0.013, 0.0167, 0.02, 0.025, 0.03, 0.05, 0.067, 0.1, 0.2). In some embodiments, the ratio of the GIP potency of the tri-agonist compared to the GLP-1 potency of the tri-agonist is less than about 100, 75, 60, 50, 40, 30, 20, 15, 10, or 5. In some embodiments, the ratio of the potency at the GIP receptor divided by the potency at the GLP-1 receptor is about 1 or less than about 1 (e.g., about 0.01, 0.013, 0.0167, 0.02, 0.025, 0.03, 0.05, 0.067, 0.1, 0.2). In related embodiments, the ratio of the EC50 of the tri-agonist at the GIP receptor divided by the EC50 of the tri-agonist at the glucagon receptor is less than about 100, 75, 60, 50, 40, 30, 20, 15, 10, or 5. In some embodiments, the ratio of the EC50 at the GIP receptor divided by the EC50 at the glucagon receptor is about 1 or less than about 1 (e.g., about 0.01, 0.013, 0.0167, 0.02, 0.025, 0.03, 0.05, 0.067, 0.1, 0.2). In some embodiments, the ratio of the GIP potency of the tri-agonist compared to the glucagon potency of the tri-agonist is less than about 500, 450, 400, 350, 300, 250, 200, 150, 100, 75, 60, 50, 40, 30, 20, 15, 10, or 5. In some embodiments, the ratio of the potency at the GIP receptor divided by the potency at the glucagon receptor is about 1 or less than about 1 (e.g., about 0.01, 0.013, 0.0167, 0.02, 0.025, 0.03, 0.05, 0.067, 0.1, 0.2). In some embodiments, the ratio of the EC50 of the tri-agonist at the GLP-1 receptor divided by the EC50 of the tri-agonist at the glucagon receptor is less than about 100, 75, 60, 50, 40, 30, 20, 15, 10, or 5. In some embodiments, the ratio of the EC50 at the GLP-1 receptor divided by the EC50 at the glucagon receptor is about 1 or less than about 1 (e.g., about 0.01, 0.013, 0.0167, 0.02, 0.025, 0.03, 0.05, 0.067, 0.1, 0.2). In some embodiments, the ratio of the GLP-1 potency of the tri-agonist compared to the glucagon potency of the tri-agonist is less than about 100, 75, 60, 50, 40, 30, 20, 15, 10, or 5. In some embodiments, the ratio of the potency at the GLP-1 receptor divided by the potency at the glucagon receptor is about 1 or less than about 1 (e.g., about 0.01, 0.013, 0.0167, 0.02, 0.025, 0.03, 0.05, 0.067, 0.1, 0.2).

In yet another aspect, Class 2 glucagon related peptides exhibit activity at the GLP-1 and GIP receptors, but in which the glucagon activity has been significantly reduced or destroyed ("GIP/GLP-1 co-agonists"), e.g., by an amino acid modification at position 3. For example, substitution at this position with an acidic, basic, or a hydrophobic amino acid (glutamic acid, ornithine, norleucine) reduces glucagon activity. In some embodiments, the EC50 of the glucagon peptide at the GIP receptor is less than about 50-fold, 40-fold, 30-fold or 20-fold different (higher or lower) from its EC50 at the GLP-1 receptor. In some embodiments, the GIP potency of the Class 2 glucagon related peptide is less than about 25-, 20-, 15-, 10-, or 5-fold different (higher or lower) from its GLP-1 potency. In some embodiments these Class 2 glucagon related peptides have about 10% or less of the activity of native glucagon at the glucagon receptor, e.g. about 1-10%, or about 0.1-10%, or greater than about 0.1% but less than about 10%. In some embodiments, the ratio of the EC50 of the Class 2 glucagon related peptide at the GIP receptor divided by the EC50 of the Class 2 glucagon related peptide at the GLP-1 receptor is less than about 100, 75, 60, 50, 40, 30, 20, 15, 10, or 5, and no less than 1. In some embodiments, the ratio of the GIP potency of the Class 2 glucagon related peptide compared to the GLP-1 potency of the Class 2 glucagon related peptide is less than about 100, 75, 60, 50, 40, 30, 20, 15, 10, or 5, and no less than 1.

In a further aspect, Class 2 glucagon related peptides exhibit activity at the GIP receptor, in which the glucagon and GLP-1 activity have been significantly reduced or destroyed ("GIP agonist glucagon peptides"), e.g., by amino acid modifications at positions 3 with Glu and 7 with Ile. In some embodiments, these Class 2 glucagon related peptides have about 10% or less of the activity of native glucagon at the glucagon receptor, e.g. about 1-10%, or about 0.1-10%, or greater than about 0.1%, 0.5%, or 1% but less than about 1%, 5%, or 10%. In some embodiments these Class 2 glucagon related peptides also have about 10% or less of the activity of native GLP-1 at the GLP-1 receptor, e.g. about 1-10%, or about 0.1-10%, or greater than about 0.1%, 0.5%, or 1% but less than about 1%, 5%, or 10%.

In some embodiments, when the Class 2 glucagon related peptide is not pegylated, the EC50 of the Class 2 glucagon related peptide for GIP receptor activation is about 4, 2, 1 nM or less, or the analog has at least about 1%, 2%, 3%, 4% or 5% of the activity of native GIP at the GIP receptor. In related embodiments, the EC50 of the unpegylated Class 2 glucagon related peptide for GLP-1 receptor activation is about 4, 2, 1 nM or less or has at least about 1%, 2%, 3%, 4% or 5% of the activity of native GLP-1 at the GLP-1 receptor. In yet other related embodiments, the EC50 of the unpegylated Class 2 glucagon related peptide for glucagon receptor activation is about 4, 2, 1 nM or less, or at least about 5%, 10%, 15% or 20% of the activity of native glucagon at the glucagon receptor. In some embodiments, the unpegylated Class 2 glucagon related peptide has less than about 1% of the activity of native glucagon at the glucagon receptor. In other embodiments, the unpegylated Class 2 glucagon related peptide has less than about 10%, 5% or 1% of the activity of native GLP-1 at the GLP-1 receptor.

In embodiments where the Class 2 glucagon related peptides are linked to hydrophilic moieties such as PEG, the relative EC50s at one or more receptors may be higher e.g., about 10-fold higher. For example, the EC50 of a pegylated analog for GIP receptor activation is about 10 nM or less, or the Class 2 glucagon related peptide has at least about 0.1%, 0.2%, 0.3%, 0.4% or 0.5% of the activity of native GIP at the GIP receptor. In related embodiments, the EC50 of a pegylated Class 2 glucagon related peptide for GLP-1 receptor activation is about 10 nM or less or has at least about 0.1%, 0.2%, 0.3%, 0.4% or 0.5% of the activity of native GLP-1 at the GLP-1 receptor. In yet other related embodiments, the EC50 of a pegylated Class 2 glucagon related peptide for glucagon receptor activation is about 10 nM or less, or at least about 0.5%, 1%, 1.5% or 2% of the activity of native glucagon at the glucagon receptor. In some embodiments, the Class 2 glucagon related peptide has less than about 1% of the activity of native glucagon at the glucagon receptor. In other embodiments, the Class 2 glucagon related peptide has less than about 10%, 5% or 1% of the activity of native GLP-1 at the GLP-1 receptor.

Modifications

The modifications disclosed herein in reference to a Class 2 glucagon related peptide permit the manipulation of glucagon (SEQ ID NO: 1001) to create glucagon peptides that exhibit increased GIP activity, glucagon activity, and/or GLP-1 activity. Other modifications disclosed herein in reference to a Class 2 glucagon related peptide prolong the half-life, increase solubility, or increase stability of the resulting peptide. Yet other modifications disclosed herein in reference to a Class 2 glucagon related peptide have no effect on activity, or can be made without destroying the desired activity or activities. Any of the combinations in reference to a Class 2 glucagon related peptide that serve the same purpose (e.g. increasing GIP activity) can be applied individually or in combination. Any of the single or sets of combinations in reference to a Class 2 glucagon related peptide that confer enhanced properties can be applied individually or in combination, e.g. increased GIP and/or GLP-1 activity can be combined with increased half-life. In related embodiments, 1, 2, 3, 4, 5, 6 or more of the amino acid modifications may be non-conservative substitutions, additions or deletions. In some embodiments, 1, 2, 3, 4, 5, 6 or more of the amino acid modifications may be conservative substitutions.

Modifications that Affect GIP Activity

Enhanced activity at the GIP receptor is provided by an amino acid modification at position 1. For example, His at position 1 is substituted with a large, aromatic amino acid, optionally Tyr, Phe, Trp, amino-Phe, nitro-Phe, chloro-Phe, sulfo-Phe, 4-pyridyl-Ala, methyl-Tyr, or 3-amino Tyr. The combination of Tyr at position 1 with stabilization of the alpha helix within the region corresponding to amino acids 12-29 provided a Class 2 glucagon related peptide that activates the GIP receptor as well as the GLP-1 receptor and the glucagon receptor. The alpha helix structure can be stabilized by, e.g., formation of a covalent or non-covalent intramolecular bridge, or substitution and/or insertion of amino acids around positions 12-29 with an alpha helix-stabilizing amino acid (e.g., an α,α-disubstituted amino acid).

Enhanced activity at the GIP receptor is also provided by amino acid modifications at positions 27 and/or 28, and optionally at position 29. For example, the Met at position 27 is substituted with a large aliphatic amino acid, optionally Leu, the Asn at position 28 is substituted with a small aliphatic amino acid, optionally Ala, and the Thr at position 29 is substituted with a small aliphatic amino acid, optionally Gly. Substitution with LAG at positions 27-29 provides increased GIP activity relative to the native MNT sequence at those positions.

Enhanced activity at the GIP receptor is also provided by an amino acid modification at position 12. For example, position 12 is substituted with a large, aliphatic, nonpolar amino acid, optionally Ile.

Enhanced activity at the GIP receptor is also provided by an amino acid modification at positions 17 and/or 18. For example, position 17 is substituted with a polar residue, optionally Gln, and position 18 is substituted with a small aliphatic amino acid, optionally Ala. A substitution with QA at positions 17 and 18 provides increased GIP activity relative to the native RR sequence at those positions.

Increased activity at the GIP receptor is provided by modifications that permit formation of an intramolecular bridge between amino acid side chains at positions from 12 to 29. For example, an intramolecular bridge can be formed by a covalent bond between the side chains of two amino acids at positions i and i+4 or between positions j and j+3, or between positions k and k+7. In exemplary embodiments, the bridge is between positions 12 and 16, 16 and 20, 20 and 24, 24 and 28, or 17 and 20. In other embodiments, non-covalent interactions such as salt bridges can be formed between positively and negatively charged amino acids at these positions.

Any of the modifications described above which increase GIP receptor activity can be applied individually or in combination. Combinations of the modifications that increase GIP receptor activity generally provide higher GIP activity than any of such modifications taken alone.

Modifications that Affect Glucagon Activity

In some embodiments, enhanced glucagon potency is provided by an amino acid modification at position 16 of native glucagon (SEQ ID NO: 1001). By way of nonlimiting example, such enhanced potency can be provided by substituting the naturally occurring serine at position 16 with glutamic acid or with another negatively charged amino acid having a side chain with a length of 4 atoms, or alternatively with any one of glutamine, homoglutamic acid, or homocysteic acid, or a charged amino acid having a side chain containing at least one heteroatom, (e.g. N, O, S, P) and with a side chain length of about 4 (or 3-5) atoms. In some embodiments the glucagon peptide retains its original selectivity for the glucagon receptor relative to the GLP-1 receptors.

Glucagon receptor activity can be reduced by an amino acid modification at position 3, e.g. substitution of the naturally occurring glutamine at position 3, with an acidic, basic, or a hydrophobic amino acid. For example substitution at position 3 with glutamic acid, ornithine, or norleucine substantially reduces or destroys glucagon receptor activity.

Maintained or enhanced activity at the glucagon receptor may be achieved by modifying the Gln at position 3 with a glutamine analog, as described herein. For example, glucagon agonists can comprise the amino acid sequence of any of SEQ ID NOs: 1243-1248, 1250, 1251, and 1253-1256.

Restoration of glucagon activity which has been reduced by amino acid modifications at positions 1 and 2 is provided by modifications that that stabilize the alpha helix structure of the C-terminal portion (amino acids 12-29) of the glucagon peptide or analog thereof. For example, an intramolecular bridge can be formed by a covalent bond between the side chains of two amino acids at positions i and i+4 or between positions j and j+3, or between positions k and k+7. In other embodiments, non-covalent interactions such as salt bridges can be formed between positively and negatively charged amino acids at these positions. In yet other embodiments, one or more α,α-disubstituted amino acids are inserted or substituted into this C-terminal portion (amino acids 12-29) at positions that retain the desired activity. For example, one, two, three or all of positions 16, 20, 21 or 24 are substituted with an α,α-disubstituted amino acid, e.g., AIB.

Modifications that Affect GLP-1 Activity

Enhanced activity at the GLP-1 receptor is provided by replacing the carboxylic acid of the C-terminal amino acid with a charge-neutral group, such as an amide or ester.

Enhanced activity at the GLP-1 receptor is also provided by stabilizing the alpha-helix structure in the C-terminal portion of glucagon (around amino acids 12-29), e.g., through formation of an intramolecular bridge between the side chains of two amino acids, or substitution and/or insertion of amino acids around positions 12-29 with an alpha helix-stabilizing amino acid (e.g., an α,α-disubstituted amino acid), as further described herein. In exemplary embodiments, the side chains of the amino acid pairs 12 and 16, 13 and 17, 16 and 20, 17 and 21, 20 and 24 or 24 and 28 (amino acid pairs in which i=12, 16, 20, or 24) are linked to one another and thus stabilize the glucagon alpha helix. In some embodiments, the bridge or linker is about 8 (or about 7-9) atoms in length, particularly when the bridge is between positions i and i+4. In some embodiments, the bridge or linker is about 6 (or about 5-7) atoms in length, particularly when the bridge is between positions j and j+3.

In some embodiments, intramolecular bridges are formed by (a) substituting the naturally occurring serine at position 16 with glutamic acid or with another negatively charged amino acid having a side chain with a length of 4 atoms, or alternatively with any one of glutamine, homoglutamic acid, or homocysteic acid, or a charged amino acid having a side chain containing at least one heteroatom, (e.g. N, O, S, P) and with a side chain length of about 4 (or 3-5) atoms, and (b) substituting the naturally occurring glutamine at position 20 with another hydrophilic amino acid having a side chain that is either charged or has an ability to hydrogen-bond, and is at least about 5 (or about 4-6) atoms in length, for example, lysine, citrulline, arginine, or ornithine. The side chains of such amino acids at positions 16 and 20 can form a salt bridge or can be covalently linked. In some embodiments the two amino acids are bound to one another to form a lactam ring.

In some embodiments, stabilization of the alpha helix structure in the C-terminal portion of the glucagon peptide is achieved through the formation of an intramolecular bridge other than a lactam bridge. For example, suitable covalent bonding methods include any one or more of olefin metathesis, lanthionine-based cyclization, disulfide bridge or modified sulfur-containing bridge formation, the use of α,ω-diaminoalkane tethers, the formation of metal-atom bridges, and other means of peptide cyclization are used to stabilize the alpha helix.

In yet other embodiments, one or more α,α-disubstituted amino acids are inserted or substituted into this C-terminal portion (amino acids 12-29) at positions that retain the desired activity. For example, one, two, three or all of positions 16, 20, 21 or 24 are substituted with an α,α-disubstituted amino acid, e.g., AIB.

Increased activity at the GLP-1 receptor is provided by an amino acid modification at position 20 as described herein.

Increased activity at the GLP-1 receptor is provided by adding GPSSGAPPPS (SEQ ID NO: 1095) or XGPSSGAPPPS (SEQ ID NO: 1096) to the C-terminus. GLP-1 activity in such analogs can be further increased by modifying the amino acid at position 18, 28 or 29, or at position 18 and 29, as described herein.

A further modest increase in GLP-1 potency is provided by modifying the amino acid at position 10 to be a large, aromatic amino acid residue, optionally Trp.

Reduced activity at the GLP-1 receptor is provided, e.g., by an amino acid modification at position 7 as described herein.

Potency at the GLP-1 receptor can be further enhanced by an alanine substitution for the native arginine at position 18.

Any of the modifications described above in reference to a Class 2 glucagon related peptide which increase GLP-1 receptor activity can be applied individually or in combination. Combinations of the modifications that increase GLP-1 receptor activity generally provide higher GLP-1 activity than any of such modifications taken alone. For example, the invention provides glucagon peptides that comprise modifications at position 16, at position 20, and at the C-terminal carboxylic acid group, optionally with a covalent bond between the amino acids at positions 16 and 20; glucagon peptides that comprise modifications at position 16 and at the C-terminal carboxylic acid group; glucagon peptides that comprise modifications at positions 16 and 20, optionally with a covalent bond between the amino acids at positions 16 and 20; and glucagon peptides that comprise modifications at position 20 and at the C-terminal carboxylic acid group.

Modifications that Improve DPP-IV Resistance

Modifications at position 1 and/or 2 can increase the peptide's resistance to dipeptidyl peptidase IV (DPP IV) cleavage. For example, position 1 and/or position 2 may be substituted with a DPP-IV resistant amino acid as described herein. In some embodiments, the amino acid at position 2 is substituted with N-methyl alanine.

It was observed that modifications at position 2 (e.g. AIB at position 2) and in some cases modifications at position 1 (e.g., DMIA at position 1) may reduce glucagon activity, sometimes significantly; surprisingly, this reduction in glucagon activity can be restored by stabilizing the alpha-helix structure in the C-terminal portion of glucagon (around amino acids 12-29), e.g., through formation of a covalent bond between the side chains of two amino acids, as described herein. In some embodiments, the covalent bond is between amino acids at positions "i" and "i+4", or positions "j" and "j+3", e.g., between positions 12 and 16, 16 and 20, 20 and 24, 24 and 28, or 17 and 20. In exemplary embodiments, this covalent bond is a lactam bridge between a glutamic acid at position 16 and a lysine at position 20. In some embodiments, this covalent bond is an intramolecular bridge other than a lactam bridge, as described herein.

Modifications that Reduce Degradation

In yet further exemplary embodiments, any of the Class 2 glucagon related peptides can be further modified to improve stability by modifying the amino acid at position 15 and/or 16 of SEQ ID NO: 1001 to reduce degradation of the peptide over time, especially in acidic or alkaline buffers. Such modifications reduce cleavage of the Asp15-Ser16 peptide bond. In exemplary embodiments, the amino acid modification at position 15 is a deletion or substitution of Asp with glutamic acid, homoglutamic acid, cysteic acid or homocysteic acid. In other exemplary embodiments, the amino acid modification at position 16 is a deletion or substitution of Ser with Thr or AIB. In other exemplary embodiments, Ser at position 16 is substituted with glutamic acid or with another negatively charged amino acid having a side chain with a length of 4 atoms, or alternatively with any one of glutamine, homoglutamic acid, or homocysteic acid.

In some embodiments, the methionine residue present at position 27 of the native peptide is modified, e.g. by deletion or substitution. Such modifications may prevent oxidative degradation of the peptide. In some embodiments, the Met at position 27 is substituted with leucine, isoleucine or norleucine. In some specific embodiments, Met at position 27 is substituted with leucine or norleucine.

In some embodiments, the Gln at position 20 and/or 24 is modified, e.g. by deletion or substitution. Such modifications can reduce degradation that occurs through deamidation of Gln. In some embodiments, the Gln at position 20 and/or 24 is substituted with Ser, Thr, Ala or AIB. In some embodiments the Gln at position 20 and/or 24 is substituted with Lys, Arg, Orn, or Citrulline.

In some embodiments, the Asp at position 21 is modified, e.g. by deletion or substitution. Such modifications can reduce degradation that occurs through dehydration of Asp to form a cyclic succinimide intermediate followed by isomerization to iso-aspartate. In some embodiments, position 21 is substituted with Glu, homoglutamic acid or homocysteic acid. In some specific embodiments, position 21 is substituted with Glu.

Stabilization of the Alpha Helix Structure

Stabilization of the alpha-helix structure in the C-terminal portion of the Class 2 glucagon related peptide (around amino acids 12-29) provides enhanced GLP-1 and/or GIP activity and restores glucagon activity which has been reduced by amino acid modifications at positions 1 and/or 2. The alpha helix structure can be stabilized by, e.g., formation of a covalent or non-covalent intramolecular bridge, or substitution and/or insertion of amino acids around positions 12-29 with an alpha helix-stabilizing amino acid (e.g., an α,α-disubstituted amino acid). Stabilization of the alpha-helix structure of a GIP agonist may be accomplished as described herein.

Acylation and Alkylation

In accordance with some embodiments, the glucagon peptides disclosed herein are modified to comprise an acyl group or alkyl group, e.g., an acyl or alkyl group which is non-native to a naturally-occurring amino acid as described herein. Acylation or alkylation can increase the half-life of the glucagon peptides in circulation. Acylation or alkylation can advantageously delay the onset of action and/or extend the duration of action at the glucagon and/or GLP-1 receptors and/or improve resistance to proteases such as DPP-IV and/or improve solubility. Activity at the glucagon and/or GLP-1 and/or GIP receptors of the glucagon peptide may be maintained after acylation. In some embodiments, the potency of the acylated glucagon peptides is comparable to the unacylated versions of the glucagon peptides. Class 2 glucagon related peptides may be acylated or alkylated at the same amino acid position where a hydrophilic moiety is linked, or at a different amino acid position, as described herein.

In some embodiments, the invention provides a glucagon peptide modified to comprise an acyl group or alkyl group covalently linked to the amino acid at position 10 of the glucagon peptide. The glucagon peptide may further comprise a spacer between the amino acid at position 10 of the glucagon peptide and the acyl group or alkyl group. In some embodiments, the acyl group is a fatty acid or bile acid, or salt thereof, e.g. a C4 to C30 fatty acid, a C8 to C24 fatty acid, cholic acid, a C4 to C30 alkyl, a C8 to C24 alkyl, or an alkyl comprising a steroid moiety of a bile acid. The spacer is any moiety with suitable reactive groups for attaching acyl or alkyl groups. In exemplary embodiments, the spacer comprises an amino acid, a dipeptide, a tripeptide, a hydrophilic bifunctional, or a hydrophobic bifunctional spacer. In some embodiments, the spacer is selected from the group consisting of: Trp, Glu, Asp, Cys and a spacer comprising $NH_2(CH_2CH_2O)n(CH_2)mCOOH$, wherein m is any integer from 1 to 6 and n is any integer from 2 to 12. Such acylated or alkylated glucagon peptides may also further comprise a hydrophilic moiety, optionally a polyethylene glycol. Any of the foregoing glucagon peptides may comprise two acyl groups or two alkyl groups, or a combination thereof.

Conjugates and Fusions

The GIP agonist can be linked, optionally via covalent bonding and optionally via a linker, to a conjugate moiety as described herein.

In other embodiments, the second peptide is XGPSSGAP-PPS (SEQ ID NO: 1096), wherein X is selected from one of the 20 common amino acids, e.g., glutamic acid, aspartic acid or glycine. In some embodiments X represents an amino acid, for example Cys, that further comprises a hydrophilic moiety covalently linked to the side chain of that amino acid. Such C-terminal extensions improve solubility and also can improve GIP or GLP-1 activity. In some embodiments wherein the glucagon peptide further comprises a carboxy terminal extension, the carboxy terminal amino acid of the extension ends in an amide group or an ester group rather than a carboxylic acid.

In some embodiments, e.g., in glucagon peptides which comprise the C-terminal extension, the threonine at position 29 of the native glucagon peptide is replaced with a glycine. For example, a glucagon peptide having a glycine substitution for threonine at position 29 and comprising the C-terminal extension of GPSSGAPPPS (SEQ ID NO: 1095) is four times as potent at the GLP-1 receptor as native glucagon modified to comprise the same C-terminal extension. This T29G substitution can be used in conjunction with other modifications disclosed herein to enhance the affinity of the glucagon peptides for the GLP-1 receptor. For example, the T29G substitution can be combined with the S16E and N20K amino acid substitutions, optionally with a lactam bridge between amino acids 16 and 20, and optionally with addition of a PEG chain as described herein.

In some embodiments an amino acid is added to the C-terminus, and the additional amino acid is selected from the group consisting of glutamic acid, aspartic acid and glycine.

Modifications that Enhance Solubility

In another embodiment, the solubility of any of the glucagon peptides can be improved by amino acid substitutions and/or additions that introduce a charged amino acid into the C-terminal portion of the peptide, preferably at a position C-terminal to position 27 of SEQ ID NO: 1001. Optionally, one, two or three charged amino acids may be introduced within the C-terminal portion, preferably C-terminal to position 27. In some embodiments the native amino acid(s) at positions 28 and/or 29 are substituted with one or two charged amino acids, and/or in a further embodiment one to three charged amino acids are also added to the C-terminus of the peptide. In exemplary embodiments, one, two or all of the charged amino acids are negatively charged. In some embodiments, the negatively charged (acidic amino acid) is aspartic acid or glutamic acid.

Additional modifications, e.g. conservative substitutions, may be made to the glucagon peptide that still allow it to retain GIP activity (and optionally GLP-1 activity and/or glucagon activity).

Other Modifications

Any of the modifications described above in reference to a Class 2 peptide which increase or decrease GIP activity, which increase or decrease glucagon receptor activity, and which increase GLP-1 receptor activity can be applied individually or in combination. Any of the modifications described above in reference to a Class 2 glucagon related peptide can also be combined with other modifications that confer other desirable properties, such as increased solubility and/or stability and/or duration of action, as described herein with regard to Class 2 glucagon related peptides. Alternatively, any of the modifications described above in reference to Class 2 glucaton related peptides can be combined with other modifications described herein in reference to Class 2 glucagon related peptides that do not substantially affect solubility or stability or activity. Exemplary modifications include but are not limited to:

(A) Improving solubility, for example, by introducing one, two, three or more charged amino acid(s) to the C-terminal portion of native glucagon, preferably at a position C-terminal to position 27. Such a charged amino acid can be introduced by substituting a native amino acid with a charged amino acid, e.g. at positions 28 or 29, or alternatively by adding a charged amino acid, e.g. after position 27, 28 or 29. In exemplary embodiments, one, two, three or all of the charged amino acids are negatively charged. In other embodiments, one, two, three or all of the charged amino acids are positively charged. Such modifications increase solubility, e.g. provide at least 2-fold, 5-fold, 10-fold, 15-fold, 25-fold, 30-fold or greater solubility relative to native glucagon at a given pH between about 5.5 and 8, e.g., pH 7, when measured after 24 hours at 25° C.

(B) Increasing solubility and duration of action or half-life in circulation by addition of a hydrophilic moiety such as a polyethylene glycol chain, as described herein, e.g. at position 16, 17, 20, 21, 24 or 29, within a C-terminal extension, or at the C-terminal amino acid of the peptide, (C) Increasing solubility and/or duration of action or half-life in circulation and/or delaying the onset of action by acylation or alkylation of the glucagon peptide, as described herein;

(D) Increasing duration of action or half-life in circulation through introducing resistance to dipeptidyl peptidase IV (DPP IV) cleavage by modification of the amino acid at position 1 or 2 as described herein.

(E) Increasing stability by modification of the Asp at position 15, for example, by deletion or substitution with glutamic acid, homoglutamic acid, cysteic acid or homocysteic acid. Such modifications can reduce degradation or cleavage at a pH within the range of 5.5 to 8, for example, retaining at least 75%, 80%, 90%, 95%, 96%, 97%, 98% or 99%, up to 100% of the original peptide after 24 hours at 25° C. Such modifications reduce cleavage of the peptide bond between Asp15-Ser16.

(F) Increasing stability by modification of the Ser at position 16, for example by substitution with Thr or AIB. Such modifications also reduce cleavage of the peptide bond between Asp15-Ser16.

(G) Increasing stability by modification of the methionine at position 27, for example, by substitution with leucine or norleucine. Such modifications can reduce oxidative degradation. Stability can also be increased by modification of the Gln at position 20 or 24, e.g. by substitution with Ser, Thr, Ala or AIB. Such modifications can reduce degradation that occurs through deamidation of Gln. Stability can be increased by modification of Asp at position 21, e.g. by substitution with Glu. Such modifications can reduce degradation that occurs through dehydration of Asp to form a cyclic succinimide intermediate followed by isomerization to iso-aspartate.

(H) Non-conservative or conservative substitutions, additions or deletions that do not substantially affect activity, for example, conservative substitutions at one or more of positions 2, 5, 9, 10, 11, 12, 13, 14, 15, 16, 17, 18, 19, 20, 21, 24, 27, 28 or 29; substitution of one or more of these positions with Ala; deletion of amino acids at one or more of positions 27, 28 or 29; or deletion of amino acid 29 optionally combined with a C-terminal amide or ester in place of the C-terminal carboxylic acid group; substitution of Lys at position 12 with Arg; substitution of Tyr at position 10 with Val or Phe;

Preservation of activity after pegylation is provided by the addition of GPSSGAPPPS (SEQ ID NO: 1095) to the C-terminus.

Some positions of the native glucagon peptide can be modified while retaining at least some of the activities of the parent peptide. Accordingly, applicants anticipate that one or more of the amino acids located at positions at positions 2, 5, 10, 11, 12, 13, 14, 17, 18, 19, 20, 21, 24, 27, 28 or 29 can be substituted with an amino acid different from that present in the native glucagon peptide, and still retain activity at the glucagon receptor.

In some embodiments, position 18 is substituted with an amino acid selected from the group consisting of Ala, Ser, or Thr. In some embodiments the amino acid at position 20 is substituted with Ser, Thr, Lys, Arg, Orn, Citrulline or AIB. In some embodiments, position 21 is substituted with Glu, homoglutamic acid or homocysteic acid. In some embodiments, the glucagon peptide comprises 1 to 10 amino acid modifications selected from positions 16, 17, 18, 20, 21, 23, 24, 27, 28 and 29. In exemplary embodiments, the modifications are one or more amino acid substitutions selected from the group consisting of Gln17, Ala18, Glu21, Ile23, Ala24, Val27 and Gly29. In some embodiments, 1 to 2 amino acids selected from positions 17-26 differ from the parent peptide. In other embodiments, 1 to 2 amino acids selected from positions 17-22 differ from the parent peptide. In yet other embodiments, the modifications are Gln17, Ala18, Glu21, Ile23 and Ala24.

In some embodiments, one or more amino acids is added to the carboxy terminus of the glucagon peptide. The amino acid is typically selected from one of the 20 common amino acids, and in some embodiments the amino acid has an amide group in place of the carboxylic acid of the native amino acid. In exemplary embodiments the added amino acid is selected from the group consisting of glutamic acid and aspartic acid and glycine.

Other modifications that do not destroy activity include W10 or R20.

In some embodiments, the Class 2 glucagon related peptides disclosed herein are modified by truncation of the C-terminus by one or two amino acid residues yet retain similar activity and potency at the glucagon, GLP-1 and/or GIP receptors. In this regard, the amino acid at position 29 and/or 28 can be deleted.

Exemplary Embodiments

In accordance with some embodiments of the invention, the analog of glucagon (SEQ ID NO: 1001) having GIP agonist activity comprises SEQ ID NO: 1001 with (a) an amino acid modification at position 1 that confers GIP agonist activity, (b) a modification which stabilizes the alpha helix structure of the C-terminal portion (amino acids 12-29) of the analog, and (c) optionally, 1 to 10 (e.g., 1, 2, 3, 4, 5, 6, 7, 8, 9, 10) further amino acid modifications. In some embodiments, the analog exhibits at least about 1% activity of native GIP at the GIP receptor or any other activity level at the GIP receptor described herein.

In certain embodiments, the modification which stabilizes the alpha helix structure is one which provides or introduces an intramolecular bridge, including, for example, a covalent intramolecular bridge, such as any of those described herein. The covalent intramolecular bridge in some embodiments is a lactam bridge. The lactam bridge of the analog of these embodiments can be a lactam bridge as described herein. See, e.g., the teachings of lactam bridges under the section "Stabilization of the Alpha Helix Structure." For example, the lactam bridge may be one which is between the side chains of amino acids at positions i and i+4 or between the side chains of amino acids at positions j and j+3, wherein i is 12, 13, 16, 17, 20 or 24, and wherein j is 17. In certain embodiments, the lactam bridge can be between the amino acids at positions 16 and 20, wherein one of the amino acids at positions 16 and 20 is substituted with Glu and the other of the amino acids at positions 16 and 20 is substituted with Lys.

In alternative embodiments, the modification which stabilizes the alpha helix structure is the introduction of one, two, three, or four α,α-disubstituted amino acids at position(s) 16, 20, 21, and 24 of the analog. In some embodiments, the α,α-disubstituted amino acid is AIB. In certain aspects, the α,α-disubstituted amino acid (e.g., AIB) is at position 20 and the amino acid at position 16 is substituted with a positive-charged amino acid, such as, for example, an amino acid of Formula IV, which is described herein. The amino acid of Formula IV may be homoLys, Lys, Orn, or 2,4-diaminobutyric acid (Dab).

In specific aspects of the invention, the amino acid modification at position 1 is a substitution of His with an amino acid lacking an imidazole side chain, e.g. a large, aromatic amino acid (e.g., Tyr).

In certain aspects, the analog of glucagon comprises amino acid modifications at one, two or all of positions 27, 28 and 29. For example, the Met at position 27 can be substituted with a large aliphatic amino acid, optionally Leu, the Asn at position 28 can be substituted with a small aliphatic amino acid, optionally Ala, the Thr at position 29 can be substituted with a small aliphatic amino acid, optionally Gly, or a combination of two or three of the foregoing. In specific embodiments, the analog of glucagon comprises Leu at position 27, Ala at position 28, and Gly or Thr at position 29.

In certain embodiments of the invention, the analog of glucagon comprises an extension of 1 to 21 amino acids C-terminal to the amino acid at position 29. The extension can comprise the amino acid sequence of SEQ ID NO: 1095 or 1096, for instance. Additionally or alternatively, the analog of glucagon can comprise an extension of which 1-6 amino acids of the extension are positive-charged amino acids. The positive-charged amino acids may be amino acids of Formula IV, including, but not limited to Lys, homoLys, Orn, and Dab.

The analog of glucagon in some embodiments is acylated or alkylated as described herein. For instance, the acyl or alkyl group may be attached to the analog of glucagon, with or without a spacer, at position 10 or 40 of the analog, as further described herein. The analog may additionally or alternatively be modified to comprise a hydrophilic moiety as further described herein. Furthermore, in some embodiments, the analog comprises any one or a combination of the following modifications:

(a) Ser at position 2 substituted with D-Ser, Ala, D-Ala, Gly, N-methyl-Ser, AIB, Val, or α-amino-N-butyric acid;
(b) Tyr at position 10 substituted with Trp, Lys, Orn, Glu, Phe, or Val:
(c) Linkage of an acyl group to a Lys at position 10;
(d) Lys at position 12 substituted with Arg or Ile;
(e) Ser at position 16 substituted with Glu, Gln, homoglutamic acid, homocysteic acid, Thr, Gly, or AIB;
(f) Arg at position 17 substituted with Gln;
(g) Arg at position 18 substituted with Ala, Ser, Thr, or Gly;
(h) Gln at position 20 substituted with Ser, Thr, Ala, Lys, Citrulline, Arg, Orn, or AIB;
(i) Asp at position 21 substituted with Glu, homoglutamic acid, homocysteic acid;
(j) Val at position 23 substituted with Ile;
(k) Gln at position 24 substituted with Asn, Ser, Thr, Ala, or AIB;
(l) and a conservative substitution at any of positions 2 5, 9, 10, 11, 12. 13, 14, 15, 16, 8 19 20, 21. 24, 27, 28, and 29.

In exemplary embodiments, the analog of glucagon (SEQ ID NO: 1001) having GIP agonist activity comprises the following modifications:

(a) an amino acid modification at position 1 that confers GIP agonist activity,
(b) a lactam bridge between the side chains of amino acids at positions i and i+4 or between the side chains of amino acids at positions j and j+3, wherein i is 12, 13, 16, 17, 20 or 24, and wherein j is 17, (c) amino acid modifications at one, two or all of positions 27, 28 and 29, e.g., amino acid modifications at position 27 and/or 28, and (d) 1-9 or 1-6 further amino acid modifications, e.g. 1, 2, 3, 4, 5, 6, 7, 8 or 9 further amino acid modifications, and the EC50 of the analog for GIP receptor activation is about 10 nM or less.

The lactam bridge of the analog of these embodiments can be a lactam bridge as described herein. See, e.g., the teachings of lactam bridges under the section "Stabilization of the Alpha Helix Structure." For example, the lactam bridge can be between the amino acids at positions 16 and 20, wherein one of the amino acids at positions 16 and 20 is substituted with Glu and the other of the amino acids at positions 16 and 20 is substituted with Lys.

In accordance with these embodiments, the analog can comprise, for example, the amino acid sequence of any of SEQ ID NOs: 1005-1094.

In other exemplary embodiments, the analog of glucagon (SEQ ID NO: 1001) having GIP agonist activity comprises the following modifications:

(a) an amino acid modification at position 1 that confers GIP agonist activity, (b) one, two, three, or all of the amino acids at positions 16, 20, 21, and 24 of the analog is substituted with an α,α-disubstituted amino acid, (c) amino acid modifications at one, two or all of positions 27, 28 and 29, e.g., amino acid modifications at position 27 and/or 28, and (d) 1-9 or 1-6 further amino acid modifications, e.g. 1, 2, 3, 4, 5, 6, 7, 8 or 9 further amino acid modifications, and the EC50 of the analog for GIP receptor activation is about 10 nM or less.

The α,α-disubstituted amino acid of the analog of these embodiments can be any α,α-disubstituted amino acid, including, but not limited to, amino iso-butyric acid (AIB), an amino acid disubstituted with the same or a different group selected from methyl, ethyl, propyl, and n-butyl, or with a cyclooctane or cycloheptane (e.g., 1-aminocyclooctane-1-carboxylic acid). In certain embodiments, the α,α-disubstituted amino acid is AIB. In certain embodiments, the amino acid at position 20 is substituted with an α,α-disubstituted amino acid, e.g., AIB.

In accordance with these embodiments, the analog can comprise, for example, the amino acid sequence of any of SEQ ID NOs: 1099-1141, 1144-1164, 1166-1169, and 1173-1178.

In yet other exemplary embodiments, the analog of glucagon (SEQ ID NO: 1001) having GIP agonist activity comprises the following modifications:

(a) an amino acid modification at position 1 that confers GIP agonist activity, (b) an amino acid substitution of Ser at position 16 with an amino acid of Formula IV:

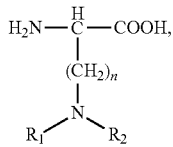

[Formula IV]

wherein n is 1 to 16, or 1 to 10, or 1 to 7, or 1 to 6, or 2 to 6, each of $R_1$ and $R_2$ is independently selected from the group consisting of H, $C_1$-$C_{18}$ alkyl, ($C_1$-$C_{18}$ alkyl) OH, ($C_1$-$C_{18}$ alkyl)$NH_2$, ($C_1$-$C_{18}$ alkyl) S H, ($C_0$-$C_4$ alkyl)($C_3$-$C_6$)cycloalkyl, ($C_0$-$C_4$ alkyl)($C_2$-$C_5$ heterocyclic), ($C_0$-$C_4$ alkyl)($C_6$-$C_{10}$ aryl)$R_7$, and ($C_1$-$C_4$ alkyl)($C_3$-$C_9$ heteroaryl), wherein $R_7$ is H or OH, and the side chain of the amino acid of Formula IV comprises a free amino group, (c) an amino acid substitution of the Gln at position 20 with an alpha, alpha-disubstituted amino acid, (d) amino acid modifications at one, two or all of positions 27, 28 and 29, e.g., amino acid modifications at position 27 and/or 28, and (e) 1-9 or 1-6 further amino acid modifications, e.g. 1, 2, 3, 4, 5, 6, 7, 8 or 9 further amino acid modifications, and the EC50 of the analog for GIP receptor activation is about 10 nM or less.

The amino acid of Formula IV of the analog of these embodiments may be any amino acid, such as, for example, the amino acid of Formula IV, wherein n is 1, 2, 3, 4, 5, 6, 7, 8, 9, 10, 11, 12, 13, 14, 15, or 16. In certain embodiments, n is 2, 3, 4, or 5, in which case, the amino acid is Dab, Orn, Lys, or homoLys respectively.

The alpha, alpha-disubstituted amino acid of the analog of these embodiments may be any alpha, alpha-disubstituted amino acid, including, but not limited to, amino iso-butyric acid (AIB), an amino acid disubstituted with the same or a different group selected from methyl, ethyl, propyl, and n-butyl, or with a cyclooctane or cycloheptane (e.g., 1-aminocyclooctane-1-carboxylic acid). In certain embodiments, the alpha, alpha-disubstituted amino acid is AIB.

In accordance with these embodiments, the analog can comprise, for example, the amino acid sequence of any of SEQ ID NOs: 1099-1165.

In yet other exemplary embodiments, the analog of glucagon (SEQ ID NO: 1001) having GIP agonist activity comprises:

(a) an amino acid modification at position 1 that confers GIP agonist activity, and (b) an extension of about 1 to about 21 amino acids C-terminal to the amino acid at position 29, wherein at least one of the amino acids of the extension is acylated or alkylated, wherein the EC50 of the analog for GIP receptor activation is about 10 nM or less.

In some embodiments, the acylated or alkylated amino acid is an amino acid of Formula I, II, or III. In more specific embodiments, the amino acid of Formula I is Dab, Orn, Lys, or homoLys. Also, in some embodiments, the extension of about 1 to about 21 amino acids comprises the amino acid sequence of GPSSGAPPPS (SEQ ID NO: 1095) or XGPSSGAPPPS (SEQ ID NO: 1096), wherein X is any amino acid, or GPSSGAPPPK (SEQ ID NO: 1170) or XGPSSGAPPPK (SEQ ID NO: 1171) or XGPSSGAPPPSK (SEQ ID NO: 1172), wherein X is Gly or a small, aliphatic or non-polar or slightly polar amino acid. In some embodiments, the about 1 to about 21 amino acids may comprise sequences containing one or more conservative substitutions relative to SEQ ID NO: 1095, 1096, 1170, 1171 or 1172. In some embodiments, the acylated or alkylated amino acid is located at position 37, 38, 39, 40, 41, 42, or 43 of the C-terminally-extended analog. In certain embodiments, the acylated or alkylated amino acid is located at position 40 of the C-terminally extended analog.

In some embodiments, the analog having GIP agonist activity further comprises amino acid modifications at one, two or all of positions 27, 28 and 29, e.g., amino acid modifications at position 27 and/or 28.

In any of the above exemplary embodiments, the amino acid modification at position 1 that confers GIP agonist activity can be a substitution of His with an amino acid lacking an imidazole side chain. The amino acid modification at position 1 can, for example, be a substitution of His with a large, aromatic amino acid. In some embodiments, the large, aromatic amino acid is any of those described herein, including, for example, Tyr.

Also, with regard to the above exemplary embodiments, amino acid modifications at one, two, or all of positions 27, 28, and 29 can be any of the modifications at these positions described herein. For example, the Met at position 27 can be substituted with a large aliphatic amino acid, optionally Leu, the Asn at position 28 can be substituted with a small aliphatic amino acid, optionally Ala, and/or the Thr at position 29 can be substituted with a small aliphatic amino acid, optionally Gly. Alternatively, the analog can comprise such amino acid modifications at position 27 and/or 28.

The analog of the above exemplary embodiments can further comprise 1-9 or 1-6 further, additional amino acid modifications, e.g. 1, 2, 3, 4, 5, 6, 7, 8 or 9 further amino acid modifications, such as, for example, any of the modifications described herein which increase or decrease the activity at any of the GIP, GLP-1, and glucagon receptors, improve solubility, improve duration of action or half-life in circulation, delay the onset of action, or increase stability. The analog can further comprise, for example, an amino acid modification at position 12, optionally, a substitution with Ile, and/or amino acid modifications at positions 17 and 18, optionally substitution with Q at position 17 and A at position 18, and/or an addition of GPSSGAPPPS (SEQ ID NO: 1095) or XGPSSGAPPPS (SEQ ID NO: 1096), or sequences containing one or more conservative substitutions relative to SEQ ID NO: 1095 or 1096, to the C-terminus. The analog can comprise one or more of the following modifications:

(i) Ser at position 2 substituted with D-Ser, Ala, D-Ala, Gly, N-methyl-Ser, AIB, Val, or α-amino-N-butyric acid;
(ii) Tyr at position 10 substituted with Trp, Lys, Orn, Glu, Phe, or Val;
(iii) Linkage of an acyl group to a Lys at position 10;
(iv) Lys at position 12 substituted with Arg;
(v) Ser at position 16 substituted with Glu, Gln, homoglutamic acid, homocysteic acid, Thr, Gly, or AIB;
(vi) Arg at position 17 substituted with Gln;
(vii) Arg at position 18 substituted with Ala, Ser, Thr, or Gly;
(viii) Gln at position 20 substituted with Ala, Ser, Thr, Lys, Citrulline, Arg, Orn, or AIB;
(ix) Asp at position 21 substituted with Glu, homoglutamic acid, homocysteic acid;
(x) Val at position 23 substituted with Ile;
(xi) Gln at position 24 substituted with Asn, Ala, Ser, Thr, or AIB; and
(xii) a conservative substitution at any of positions 2, 5, 9, 10, 11, 12, 13, 14, 15, 16, 17, 18, 19, 20, 21, 24, 27, 28, and 29.

The analog in some embodiments comprise a combination of the modifications (i) through (xii). Alternatively or additionally, the analog can comprise an amino acid modification at position 3 (e.g., an amino acid substitution of Gln with Glu), wherein the analog has less than 1% of the activity of glucagon at the glucagon receptor. Alternatively or additionally, the analog can comprise an amino acid modification at position 7 (e.g., an amino acid substitution of Thr with an amino acid lacking a hydroxyl group, e.g., Abu or Ile), wherein the analog has less than about 10% of the activity of GLP-1 at the GLP-1 receptor.

With regard to the exemplary embodiments, the analog can be covalently linked to a hydrophilic moiety. In some embodiments, the analog is covalently linked to the hydrophilic moiety at any of amino acid positions 16, 17, 20, 21, 24, 29, 40, or the C-terminus. In certain embodiments, the analog comprises a C-terminal extension (e.g., an amino acid sequence of SEQ ID NO: 1095) and an addition of an amino acid comprising the hydrophilic moiety, such that the hydrophilic moiety is covalently linked to the analog at position 40.

In some embodiments, the hydrophilic moiety is covalently linked to a Lys, Cys, Orn, homocysteine, or acetyl-phenylalanine of the analog. The Lys, Cys, Orn, homocysteine, or acetyl-phenylalanine may be an amino acid that is native to the glucagon sequence (SEQ ID NO: 1001) or it may be an amino acid which is replacing a native amino acid of SEQ ID NO: 1001. In some embodiments, wherein the hydrophilic moiety is attached to a Cys, the linkage to the hydrophilic moiety can comprise the structure

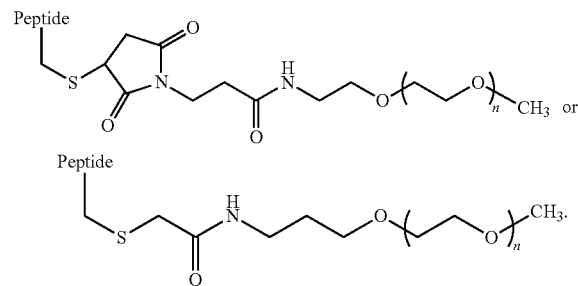

With regard to the analogs comprising a hydrophilic moiety, the hydrophilic moiety may be any of those described herein. See, e.g., the teachings under the section "Linkage of hydrophilic moieties." In some embodiments, the hydrophilic moiety is a polyethylene glycol (PEG). The PEG in certain embodiments has a molecular weight of about 1,000 Daltons to about 40,000 Daltons, e.g., about 20,000 Daltons to about 40,000 Daltons.

With regard to the exemplary embodiments, the analog can comprise a modified amino acid in which the side chain is covalently linked to an acyl or alkyl group (e.g., an acyl or alkyl group which is non-native to a naturally-occurring amino acid). The acylated or alkylated analog can be in accordance with acylated or alkylated peptides described in the section "Acylation and alkylation." In some embodiments, the acyl group is a C4 to a C30 fatty acyl group, such as, for example, a C10 fatty acyl or alkyl group, a C12 fatty acyl or alkyl group, a C14 fatty acyl or alkyl group, a C16 fatty acyl or alkyl group, a C18 fatty acyl or alkyl group, a C20 acyl or alkyl group, or a C22 acyl or alkyl group. The acyl or alkyl group may be covalently attached to any amino acid of the analog, including, but not limited to the amino acid at position 10 or 40, or the C-terminal amino acid. In certain embodiments, the analog comprises a C-terminal extension (e.g., an amino acid sequence of SEQ ID NO: 1095) and an addition of an amino acid comprising the acyl or alkyl group, such that the acyl or alkyl group is covalently linked to the analog at position 40. In some embodiments, the acyl or alkyl group is covalently linked to the side chain of an amino acid of Formula I, II, or III, e.g., a Lys residue. The acyl or alkyl group may be covalently linked to an amino acid which is native to the glucagon sequence (SEQ ID NO: 1001) or may be linked to an amino acid which is added to the sequence of SEQ ID NO: 1001 or to the sequence of SEQ ID NO: 1001 followed by SEQ ID NO: 1095 (at the N- or C-terminus) or may be linked to an amino acid which replaces a native amino acid, e.g., the Tyr at position 10 of SEQ ID NO: 1001.

In the above exemplary embodiments, wherein the analog comprises an acyl or alkyl group, the analog may be attached to the acyl or alkyl group via a spacer, as described herein. The spacer, for example, may be 3 to 10 atoms in length and may be, for instance, an amino acid (e.g., 6-amino hexanoic acid, any amino acid described herein), a dipeptide (e.g., Ala-Ala, βAla-βAla, Leu-Leu, Pro-Pro, γGlu-γGlu), a tripeptide, or a hydrophilic or hydrophobic bifunctional spacer. In certain aspects, the total length of the spacer and the acyl or alkyl group is about 14 to about 28 atoms. In some embodiments, the amino acid spacer is not γ-Glu. In some embodiments, the dipeptide spacer is not γ-Glu-γ-Glu.

In still further exemplary embodiments, the analog of glucagon having GIP agonist activity comprises the amino acid sequence according to any one of SEQ ID NOs: 1227, 1228, 1229 or 1230 that further comprises the following modifications:
   (a) optionally, an amino acid modification at position 1 that confers GIP agonist activity,
   (b) an extension of about 1 to about 21 amino acids C-terminal to the amino acid at position 29, wherein at least one of the amino acids of the extension is acylated or alkylated, and
   (d) up to 6 further amino acid modifications,
wherein the EC50 of the analog for GIP receptor activation is about 10 nM or less.

In some aspects, the acylated or alkylated amino acid is an amino acid of Formula I, II, or III. In more specific embodiments, the amino acid of Formula I is Dab, Orn, Lys, or homoLys. Also, in some embodiments, the about 1 to about 21 amino acids comprises the amino acid sequence of GPSS-GAPPPS (SEQ ID NO: 1095) or XGPSSGAPPPS (SEQ ID NO: 1096), wherein X is any amino acid, or GPSSGAPPPK (SEQ ID NO: 1170) or XGPSSGAPPPK (SEQ ID NO: 1171) or XGPSSGAPPPSK (SEQ ID NO: 1172), wherein X is Gly or a small, aliphatic or non-polar or slightly polar amino acid. In some embodiments, the about 1 to about 21 amino acids may comprise sequences containing one or more conservative substitutions relative to SEQ ID NO: 1095, 1096, 1170, 1171 or 1172. In some embodiments, the acylated or alkylated amino acid is located at position 37, 38, 39, 40, 41, 42, or 43 of the C-terminally-extended analog. In certain embodiments, the acylated or alkylated amino acid is located at position 40 of the C-terminally extended analog.

In any of the above exemplary embodiments, the amino acid at position 1 that confers GIP agonist activity can be an amino acid lacking an imidazole side chain. The amino acid at position 1 can, for example, be a large, aromatic amino acid. In some embodiments, the large, aromatic amino acid is any of those described herein, including, for example, Tyr.

The analog of the above exemplary embodiments can further comprise 1-6 further amino acid modifications, such as, for example, any of the modifications described herein which increase or decrease the activity at any of the GIP, GLP-1, and glucagon receptors, improve solubility, improve duration of action or half-life in circulation, delay the onset of action, or increase stability.

In certain aspects, glucagon analogs described in the above exemplary embodiment, comprise further amino acid modifications at one, two or all of positions 27, 28 and 29. Modifications at these positions can be any of the modifications described herein relative to these positions. For example, relative to SEQ ID NO: 1227, 1228, 1229 or 1230, position 27 can be substituted with a large aliphatic amino acid (e.g., Leu, Ile or norleucine) or Met, position 28 can be substituted with another small aliphatic amino acid (e.g., Gly or Ala) or Asn, and/or position 29 can be substituted with another small aliphatic amino acid (e.g., Ala or Gly) or Thr. Alternatively, the analog can comprise such amino acid modifications at position 27 and/or 28.

The analog can further comprise one or more of the following additional modifications:
   (i) the amino acid at position 2 is any one of D-Ser, Ala, D-Ala, Gly, N-methyl-Ser, AIB, Val, or α-amino-N-butyric acid;
   (ii) the amino acid at position 10 is Tyr, Trp, Lys, Orn, Glu, Phe, or Val;
   (iii) linkage of an acyl group to a Lys at position 10;
   (iv) the amino acid at position 12 is Ile, Lys or Arg;
   (v) the amino acid at position 16 is any one of Ser, Glu, Gln, homoglutamic acid, homocysteic acid, Thr, Gly, or AIB;
   (vi) the amino acid at position 17 is Gln or Arg;
   (vii) the amino acid at position 18 is any one of Ala, Arg, Ser, Thr, or Gly;
   (viii) the amino acid at position 20 is any one of Ala, Ser, Thr, Lys, Citrulline, Arg, Orn, or AIB or another alpha, alpha-disubstituted amino acid;
   (ix) the amino acid at position 21 is any one of Glu, Asp, homoglutamic acid, homocysteic acid;
   (x) the amino acid at position 23 is Val or Ile;
   (xi) the amino acid at position 24 is any one of Gln, Asn, Ala, Ser, Thr, or AIB; and
   (xii) one or more conservative substitutions at any of positions 2, 5, 9, 10, 11, 12, 13, 14, 15, 16, 17, 18, 19, 20, 21, 24, 27, 28, and 29.

The analog in some embodiments comprise a combination of the modifications (i) through (xii). Alternatively or additionally, the analog can comprise an amino acid modification at position 3 (e.g., an amino acid substitution of Gln with Glu), wherein the analog has less than 1% of the activity of glucagon at the glucagon receptor. Alternatively or additionally, the analog can comprise an amino acid modification at position 7 (e.g., an amino acid substitution of Thr with an amino acid lacking a hydroxyl group, e.g., Abu or Ile), wherein the analog has less than about 10% of the activity of GLP-1 at the GLP-1 receptor.

With regard to the exemplary embodiments, the analog can be covalently linked to a hydrophilic moiety. In some embodiments, the analog is covalently linked to the hydrophilic moiety at any of amino acid positions 16, 17, 20, 21, 24, 29, 40, or the C-terminus. In certain embodiments, the analog comprises a hydrophilic moiety covalently linked to the analog at position 24.

In some embodiments, the hydrophilic moiety is covalently linked to a Lys, Cys, Orn, homocysteine, or acetyl-phenylalanine of the analog. The Lys, Cys, Orn, homocysteine, or acetyl-phenylalanine may be an amino acid that is native to SEQ ID NO: 1001, 1227, 1228, 1229 or 1230 or it may be a substituted amino acid. In some embodiments, wherein the hydrophilic moiety is linked to a Cys, the linkage may comprise the structure

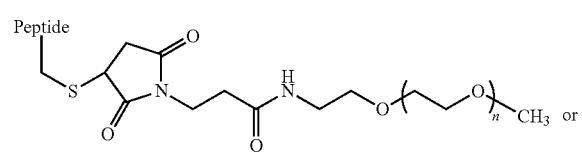

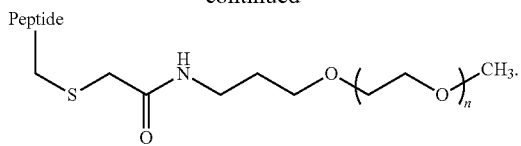

With regard to the analogs comprising a hydrophilic moiety, the hydrophilic moiety may be any of those described herein. See, e.g., the teachings under the section "Linkage of hydrophilic moieties." In some embodiments, the hydrophilic moiety is a polyethylene glycol (PEG). The PEG in certain embodiments has a molecular weight of about 1,000 Daltons to about 40,000 Daltons, e.g., about 20,000 Daltons to about 40,000 Daltons.

With regard to the exemplary embodiments, the analog can comprise a modified amino acid within the C-terminal extension in which the side chain is covalently linked to an acyl or alkyl group. The acylated or alkylated analog can be in accordance with acylated or alkylated peptides described in the section "Acylation and alkylation." In some embodiments, the acyl group is a C4 to a C30 fatty acyl group, such as, for example, a C10 fatty acyl or alkyl group, a C12 fatty acyl or alkyl group, a C14 fatty acyl or alkyl group, a C16 fatty acyl or alkyl group, a C18 fatty acyl or alkyl group, a C20 acyl or alkyl group, or a C22 acyl or alkyl group. The acyl or alkyl group may be covalently attached to any amino acid of the analog, including, but not limited to the amino acid at position 10 or 40, or the C-terminal amino acid. In some embodiments, the acyl or alkyl group is covalently linked to the side chain of an amino acid of Formula I, II, or III, e.g., a Lys residue. The acyl or alkyl group is covalently linked to an amino acid which is native to SEQ ID NO: 1001, 1227, 1228, 1229 or 1230 or it may be linked to a substituted amino acid. The acyl or alkyl group is covalently linked to an amino acid which is native to SEQ ID NO: 1095, 1096, 1171 or 1172, or it may be linked to a substituted amino acid.

In the above exemplary embodiments, wherein the analog comprises an acyl or alkyl group, the analog may be attached to the acyl or alkyl group via a spacer, as described herein. The spacer, for example, may be 3 to 10 atoms in length and may be, for instance, an amino acid (e.g., 6-amino hexanoic acid, any amino acid described herein), a dipeptide (e.g., Ala-Ala, βAla-βAla, Leu-Leu, Pro-Pro, γGlu-γGlu), a tripeptide, or a hydrophilic or hydrophobic bifunctional spacer. In certain aspects, the total length of the spacer and the acyl or alkyl group is about 14 to about 28 atoms. In some embodiments, the amino acid spacer is not γ-Glu. In some embodiments, the dipeptide spacer is not γ-Glu-γ-Glu.

In some very specific embodiments, an analog of the invention comprises an amino acid sequence selected from the group consisting of SEQ ID NOs: 1099-1141, 1144-1164, 1166, 1192-1207, 1209-1221 and 1223 or selected from the group consisting of SEQ ID NOs: 1167-1169, 1173-1178 and 1225.

Further, specific examples of analogs of the invention include but are not limited to, any of those referenced in Tables 1-3.

In still further exemplary embodiments, the analog of glucagon having GIP agonist activity comprises an acyl or alkyl group (e.g., an acyl or alkyl group which is non-native to a naturally occurring amino acid), wherein the acyl or alkyl group is attached to a spacer, wherein (i) the spacer is attached to the side chain of the amino acid at position 10 of the analog; or (ii) the analog comprises an extension of 1 to 21 amino acids C-terminal to the amino acid at position 29 and the spacer is attached to the side chain of an amino acid corresponding to one of positions 37-43 relative to SEQ ID NO: 1001, wherein the EC50 of the analog for GIP receptor activation is about 10 nM or less.

In such embodiments, the analog may comprise an amino acid sequence of SEQ ID NO: 1001 with (i) an amino acid modification at position 1 that confers GIP agonist activity, (ii) amino acid modifications at one, two, or all of positions 27, 28, and 29, (iii) at least one of:

(A) the analog comprises a lactam bridge between the side chains of amino acids at positions i and i+4 or between the side chains of amino acids at positions j and j+3, wherein i is 12, 13, 16, 17, 20 or 24, and wherein j is 17;

(B) one, two, three, or all of the amino acids at positions 16, 20, 21, and 24 of the analog is substituted with an α,α-disubstituted amino acid; or (C) the analog comprises (i) an amino acid substitution of Ser at position 16 with an amino acid of Formula IV:

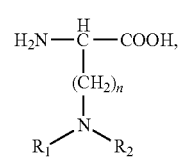

[Formula IV]

wherein n is 1 to 7, wherein each of R1 and R2 is independently selected from the group consisting of H, $C_1$-$C_{18}$ alkyl, ($C_1$-$C_{18}$ alkyl)OH, ($C_1$-$C_{18}$ alkyl)NH$_2$, ($C_1$-$C_{18}$ alkyl)SH, ($C_0$-$C_4$ alkyl)($C_3$-$C_6$)cycloalkyl, ($C_0$-$C_4$ alkyl)($C_2$-$C_5$ heterocyclic), ($C_0$-$C_4$ alkyl)($C_6$-$C_{10}$ aryl)R$_7$, and ($C_1$-$C_4$ alkyl)($C_3$-$C_9$ heteroaryl), wherein R$_7$ is H or OH, and the side chain of the amino acid of Formula IV comprises a free amino group; and (ii) an amino acid substitution of the Gln at position 20 with an alpha, alpha-disubstituted amino acid.

and (iv) up to 6 further amino acid modifications.

The alpha, alpha-disubstituted amino acid of the analog of these embodiments may be any alpha, alpha-disubstituted amino acid, including, but not limited to, amino iso-butyric acid (AIB), an amino acid disubstituted with the same or a different group selected from methyl, ethyl, propyl, and n-butyl, or with a cyclooctane or cycloheptane (e.g., 1-aminocyclooctane-1-carboxylic acid). In certain embodiments, the alpha, alpha-disubstituted amino acid is AIB.

The amino acid of Formula IV of the analog of these embodiments may be any amino acid, such as, for example, the amino acid of Formula IV, wherein n is 1, 2, 3, 4, 5, 6, 7, 8, 9, 10, 11, 12, 13, 14, 15, or 16. In certain embodiments, n is 2, 3, 4, or 5, in which case, the amino acid is Dab, Orn, Lys, or homoLys respectively.

In any of the above exemplary embodiments, the amino acid modification at position 1 that confers GIP agonist activity can be a substitution of His with an amino acid lacking an imidazole side chain. The amino acid modification at position 1 can, for example, be a substitution of His with a large, aromatic amino acid. In some embodiments, the large, aromatic amino acid is any of those described herein, including, for example, Tyr.

Also, with regard to the above exemplary embodiments, amino acid modifications at one, two, or all of positions 27, 28, and 29 can be any of the modifications at these positions described herein. For example, the Met at position 27 can be substituted with a large aliphatic amino acid, optionally Leu, the Asn at position 28 can be substituted with a small aliphatic amino acid, optionally Ala, and/or the Thr at position 29 can be substituted with a small aliphatic amino acid, optionally Gly. Alternatively, the analog can comprise such amino acid modifications at position 27 and/or 28.

The analog of the above exemplary embodiments can further comprise 1-9 or 1-6 further, additional amino acid modifications, e.g. 1, 2, 3, 4, 5, 6, 7, 8 or 9 further amino acid modifications, such as, for example, any of the modifications described herein which increase or decrease the activity at any of the GIP, GLP-1, and glucagon receptors, improve solubility, improve duration of action or half-life in circulation, delay the onset of action, or increase stability. The analog can further comprise, for example, an amino acid modification at position 12, optionally, a substitution with Ile, and/or amino acid modifications at positions 17 and 18, optionally substitution with Q at position 17 and A at position 18, and/or an addition of GPSSGAPPPS (SEQ ID NO: 1095) or XGPSSGAPPPS (SEQ ID NO: 1096), or sequences containing one or more conservative substitutions relative to SEQ ID NO: 1095 or 1096, to the C-terminus. The analog can comprise one or more of the following modifications:

(i) Ser at position 2 substituted with D-Ser, Ala, D-Ala, Gly, N-methyl-Ser, AIB, Val, or α-amino-N-butyric acid;
(ii) Tyr at position 10 substituted with Trp, Lys, Orn, Glu, Phe, or Val;
(iii) Linkage of an acyl group to a Lys at position 10;
(iv) Lys at position 12 substituted with Arg;
(v) Ser at position 16 substituted with Glu, Gln, homoglutamic acid, homocysteic acid, Thr, Gly, Lys, or AIB;
(vi) Arg at position 17 substituted with Gln;
(vii) Arg at position 18 substituted with Ala, Ser, Thr, or Gly;
(viii) Gln at position 20 substituted with Ala, Ser, Thr, Lys, Citrulline, Arg, Orn, or AIB;
(ix) Asp at position 21 substituted with Glu, homoglutamic acid, homocysteic acid;
(x) Val at position 23 substituted with Ile;
(xi) Gln at position 24 substituted with Asn, Ala, Ser, Thr, or AIB; and
(xii) a conservative substitution at any of positions 2, 5, 9, 10, 11, 12, 13, 14, 15, 16, 17, 18, 19, 20, 21, 24, 27, 28, and 29.

The analog in some embodiments comprise a combination of the modifications (i) through (xii). Alternatively or additionally, the analog can comprise an amino acid modification at position 3 (e.g., an amino acid substitution of Gln with Glu), wherein the analog has less than 1% of the activity of glucagon at the glucagon receptor. Alternatively or additionally, the analog can comprise an amino acid modification at position 7 (e.g., an amino acid substitution of Thr with an amino acid lacking a hydroxyl group, e.g., Abu or Ile), a deletion of the amino acid(s) C-terminal to the amino acid at position 27 or 28, yielding a 27- or 28-amino acid peptide, or a combination thereof, wherein the analog has less than about 10% of the activity of GLP-1 at the GLP-1 receptor.

With regard to the exemplary embodiments, the analog can be covalently linked to a hydrophilic moiety. In some embodiments, the analog is covalently linked to the hydrophilic moiety at any of amino acid positions 16, 17, 20, 21, 24, 29, 40, or the C-terminus. In certain embodiments, the analog comprises a C-terminal extension (e.g., an amino acid sequence of SEQ ID NO: 1095) and an addition of an amino acid comprising the hydrophilic moiety, such that the hydrophilic moiety is covalently linked to the analog at position 40.

In some embodiments, the hydrophilic moiety is covalently linked to a Lys, Cys, Orn, homocysteine, or acetylphenylalanine of the analog. The Lys, Cys, Orn, homocysteine, or acetyl-phenylalanine may be an amino acid that is native to the glucagon sequence (SEQ ID NO: 1001) or it may be an amino acid which is replacing a native amino acid of SEQ ID NO: 1001. In some embodiments, wherein the hydrophilic moiety is attached to a Cys, the linkage to the hydrophilic moiety can comprise the structure

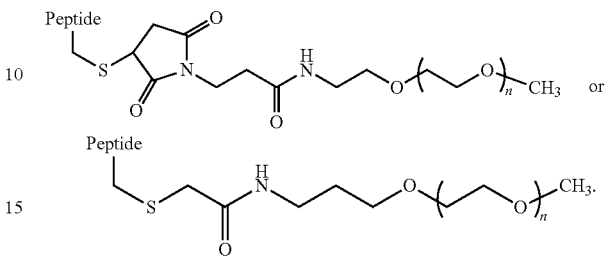

With regard to the analogs comprising a hydrophilic moiety, the hydrophilic moiety may be any of those described herein. See, e.g., the teachings under the section "Linkage of hydrophilic moieties." In some embodiments, the hydrophilic moiety is a polyethylene glycol (PEG). The PEG in certain embodiments has a molecular weight of about 1,000 Daltons to about 40,000 Daltons, e.g., about 20,000 Daltons to about 40,000 Daltons.

In the exemplary embodiments, wherein the analog comprises an acyl or alkyl group, which is attached to the analog via a spacer, the spacer can be any spacer as described herein. The spacer, for example, may be 3 to 10 atoms in length and may be, for instance, an amino acid (e.g., 6-amino hexanoic acid, any amino acid described herein), a dipeptide (e.g., Ala-Ala, βAla-βAla, Leu-Leu, Pro-Pro, γGlu-γGlu), a tripeptide, or a hydrophilic or hydrophobic bifunctional spacer. In certain aspects, the total length of the spacer and the acyl or alkyl group is about 14 to about 28 atoms. In some embodiments, the amino acid spacer is not γ-Glu. In some embodiments, the dipeptide spacer is not γ-Glu-γ-Glu.

The acyl or alkyl group is any acyl or alkyl group as described herein, such as an acyl or alkyl group which is non-native to a naturally occurring amino acid. The acyl or alkyl group in some embodiments is a C4 to C30 fatty acyl group, such as, for example, a C10 fatty acyl or alkyl group, a C12 fatty acyl or alkyl group, a C14 fatty acyl or alkyl group, a C16 fatty acyl or alkyl group, a C18 fatty acyl or alkyl group, a C20 acyl or alkyl group, or a $C_{2\text{-}2}$ acyl or alkyl group, or a $C_4$ to $C_{30}$ alkyl group. In specific embodiments, the acyl group is a C12 to C18 fatty acyl group (e.g., a C14 or C16 fatty acyl group).

In some embodiments, the extension of about 1 to about 21 amino acids C-terminal to the amino acid at position 29 of the analog comprises the amino acid sequence of GPSSGAPPPS (SEQ ID NO: 1095) or XGPSSGAPPPS (SEQ ID NO: 1096), wherein X is any amino acid, or GPSSGAPPPK (SEQ ID NO: 1170) or XGPSSGAPPPK (SEQ ID NO: 1171) or XGPSSGAPPPSK (SEQ ID NO: 1172), wherein X is Gly or a small, aliphatic or non-polar or slightly polar amino acid. In some embodiments, the about 1 to about 21 amino acids may comprise sequences containing one or more conservative substitutions relative to SEQ ID NO: 1095, 1096, 1170, 1171 or 1172. In some embodiments, the acylated or alkylated amino acid is located at position 37, 38, 39, 40, 41, 42, or 43 of the C-terminally-extended analog. In certain embodiments, the acylated or alkylated amino acid is located at position 40 of the C-terminally extended analog.

The GIP agonist may be a peptide comprising the amino acid sequence of any of the amino acid sequences, e.g., SEQ ID NOs: 1005-1094, optionally with up to 1, 2, 3, 4, or 5 further modifications that retain GIP agonist activity. In certain embodiments, the GIP agonist comprises the amino acids of any of SEQ ID NOs: 1099-1262.

Class 3 Glucagon Related Peptides

In certain embodiments, the glucagon related peptide is a Class 3 glucagon related peptide, which is described herein and in International Patent Application No. PCT/US2009/47438 (filed on Jun. 16, 2009), International Patent Application Publication No. WO 2008/101017, published on Aug. 21, 2008, and U.S. Provisional Application No. 61/090,412 and U.S. Application No. 61/177,476, the contents of which are incorporated by reference in their entirety.

Some of the biological sequences referenced in the following section (SEQ ID NOs: 1-656) relating to Class 3 glucagon related peptides are correspond to SEQ ID NOs: 1-656 in International Patent Application No. PCT/US2009/47438.

Activity

The Class 3 glucagon related peptide can be a peptide that exhibits increased activity at the glucagon receptor, and in further embodiments exhibits enhanced biophysical stability and/or aqueous solubility. In addition, in some embodiments, the Class 3 glucagon related peptide has lost native glucagon's selectivity for the glucagon receptor verses the GLP-1 receptor, and thus represents co-agonists of those two receptors. Selected amino acid modifications within the Class 3 glucagon related peptide can control the relative activity of the peptide at the GLP-1 receptor verses the glucagon receptor. Thus, the Class 3 glucagon related peptide can be a glucagon/GLP-1 co-agonist that has higher activity at the glucagon receptor versus the GLP-1 receptor, a glucagon/GLP-1 co-agonist that has approximately equivalent activity at both receptors, or a glucagon/GLP-1 co-agonist that has higher activity at the GLP-1 receptor versus the glucagon receptor. The latter category of co-agonist can be engineered to exhibit little or no activity at the glucagon receptor, and yet retain ability to activate the GLP-1 receptor with the same or better potency than native GLP-1. Any of these co-agonists may also include modifications that confer enhanced biophysical stability and/or aqueous solubility.

Modifications of the Class 3 glucagon related peptide can be made to produce a glucagon peptide having anywhere from at least about 1% (including at least about 1.5%, 2%, 5%, 7%, 10%, 20%, 30%, 40%, 50%, 60%, 75%, 100%, 125%, 150%, 175%) to about 200% or higher activity at the GLP-1 receptor relative to native GLP-1 and anywhere from at least about 1% (including about 1.5%, 2%, 5%, 7%, 10%, 20%, 30%, 40%, 50%, 60%, 75%, 100%, 125%, 150%, 175%, 200%, 250%, 300%, 350%, 400%, 450%) to about 500% or higher activity at the glucagon receptor relative to native glucagon. The amino acid sequence of native glucagon is SEQ ID NO: 1, the amino acid sequence of GLP-1(7-36) amide is SEQ ID NO: 52, and the amino acid sequence of GLP-1(7-37)acid is SEQ ID NO: 50. In exemplary embodiments, a Class 3 glucagon related peptide may exhibit at least 10% of the activity of native glucagon at the glucagon receptor and at least 50% of the activity of native GLP-1 at the GLP-1 receptor, or at least 40% of the activity of native glucagon at the glucagon receptor and at least 40% of the activity of native GLP-1 at the GLP-1 receptor, or at least 60% of the activity of native glucagon at the glucagon receptor and at least 60% of the activity of native GLP-1 at the GLP-1 receptor.

Selectivity of a Class 3 glucagon related peptide for the glucagon receptor versus the GLP-1 receptor can be described as the relative ratio of glucagon/GLP-1 activity (the peptide's activity at the glucagon receptor relative to native glucagon, divided by the peptide's activity at the GLP-1 receptor relative to native GLP-1). For example, a Class 3 glucagon related peptide that exhibits 60% of the activity of native glucagon at the glucagon receptor and 60% of the activity of native GLP-1 at the GLP-1 receptor has a 1:1 ratio of glucagon/GLP-1 activity. Exemplary ratios of glucagon/GLP-1 activity include about 1:1, 1.5:1, 2:1, 3:1, 4:1, 5:1, 6:1, 7:1, 8:1, 9:1 or 10:1, or about 1:10, 1:9, 1:8, 1:7, 1:6, 1:5, 1:4, 1:3, 1:2, or 1:1.5. As an example, a glucagon/GLP-1 activity ratio of 10:1 indicates a 10-fold selectivity for the glucagon receptor versus the GLP-1 receptor. Similarly, a GLP-1/glucagon activity ratio of 10:1 indicates a 10-fold selectivity for the GLP-1 receptor versus the glucagon receptor.

In some embodiments, the Class 3 glucagon related peptides have about 10% or less of the activity of native glucagon at the glucagon receptor, e.g. about 1-10%, or about 0.1-10%, or greater than about 0.1% but less than about 10%, while exhibiting at least 20% of the activity of GLP-1 at the GLP-1 receptor. For example, exemplary Class 3 glucagon related peptides described herein have about 0.5%, about 1% or about 7% of the activity of native glucagon, while exhibiting at least 20% of the activity of GLP-1 at the GLP-1 receptor.

The Class 3 glucagon related peptide can be a glucagon peptide with increased or decreased activity at the glucagon receptor, or GLP-1 receptor, or both. The Class 3 glucagon related peptide can be a glucagon peptide with altered selectivity for the glucagon receptor versus the GLP-1 receptor.

Thus, as disclosed herein high potency Class 3 glucagon related peptides are provided that also exhibit improved solubility and/or stability. An exemplary high potency Class 3 glucagon related peptide exhibits at least about 200% of the activity of native glucagon at the glucagon receptor, and optionally is soluble at a concentration of at least 1 mg/mL at a pH between 6 and 8, or between 6 and 9, or between 7 and 9 (e.g. pH 7), and optionally retains at least 95% of the original peptide (e.g. 5% or less of the original peptide is degraded or cleaved) after 24 hours at 25-C. As another example, an exemplary Class 3 glucagon related peptide exhibits greater than about 40% or greater than about 60% activity at both the glucagon and the GLP-1 receptors (at a ratio between about 1:3 and 3:1, or between about 1:2 and 2:1), is optionally soluble at a concentration of at least 1 mg/mL at a pH between 6 and 8 or between 6 and 9, or between 7 and 9 (e.g. pH 7), and optionally retains at least 95% of the original peptide after 24 hours at 25° C. Another exemplary Class 3 glucagon related peptide exhibits about 175% or more of the activity of native glucagon at the glucagon receptor and about 20% or less of the activity of native GLP-1 at the GLP-1 receptor, is optionally soluble at a concentration of at least 1 mg/mL at a pH between 6 and 8 or between 6 and 9, or between 7 and 9 (e.g. pH 7), and optionally retains at least 95% of the original peptide after 24 hours at 25° C. Yet another exemplary Class 3 glucagon related peptide exhibits about 10% or less of the activity of native glucagon at the glucagon receptor and at least about 20% of the activity of native GLP-1 at the GLP-1 receptor, is optionally soluble at a concentration of at least 1 mg/mL at a pH between 6 and 8 or between 6 and 9, or between 7 and 9 (e.g. pH 7), and optionally retains at least 95% of the original peptide after 24 hours at 25° C. Yet another exemplary Class 3 glucagon related peptide exhibits about 10% or less but above 0.1%, 0.5% or 1% of the activity of native glucagon at the glucagon receptor and at least about 50%, 60%, 70%, 80%, 90% or 100% or more of the activity of native GLP-1 at the GLP-1 receptor, is optionally soluble at a concentration of at least 1 mg/mL at a pH between 6 and 8 or between 6 and 9, or between 7 and 9 (e.g. pH 7), and optionally retains at least 95% of the original peptide after 24 hours at 25° C. In some embodiments, such Class 3 glucagon related peptides retain at least 22, 23, 24, 25, 26, 27 or 28 of the naturally occurring amino acids at the corresponding positions in native glucagon (e.g. have 1-7, 1-5 or 1-3 modifications relative to naturally occurring glucagon).

Modifications Affecting Glucagon Activity

Increased activity at the glucagon receptor is provided by an amino acid modification at position 16 of native glucagon (SEQ ID NO: 1). In some embodiments, the Class 3 glucagon related peptide is a glucagon agonist that has been modified relative to the wild type peptide of His-Ser-Gln-Gly-Thr-Phe-Thr-Ser-Asp-Tyr-Ser-Lys-Tyr-Leu-Asp-Ser-Arg-Arg-Ala-Gln-Asp-Phe-Val-Gln-Trp-Leu-Met-Asn-Thr (SEQ ID NO: 1) to enhance the peptide's potency at the glucagon receptor. The normally occurring serine at position 16 of native glucagon (SEQ ID NO: 1) can be substituted with select acidic amino acids to enhance the potency of glucagon, in terms of its ability to stimulate cAMP synthesis in a validated in vitro model assay (see Example 5). More particularly, this substitution enhances the potency of the analog at least 2-fold, 4-fold, 5-fold, and up to 10-fold greater at the glucagon receptor. This substitution also enhances the analog's activity at the GLP-1 receptor at least 5-fold, 10-fold, or 15-fold relative to native glucagon, but selectivity is maintained for the glucagon receptor over the GLP-1 receptor.

By way of nonlimiting example, such enhanced potency can be provided by substituting the naturally occurring serine at position 16 with glutamic acid or with another negatively charged amino acid having a side chain with a length of 4 atoms, or alternatively with any one of glutamine, homoglutamic acid, or homocysteic acid, or a charged amino acid having a side chain containing at least one heteroatom, (e.g. N, O, S, P) and with a side chain length of about 4 (or 3-5) atoms. In accordance with some embodiments, the serine residue at position 16 of native glucagon is substituted with an amino acid selected from the group consisting of glutamic acid, glutamine, homoglutamic acid, homocysteic acid, threonine, or glycine. In accordance with some embodiments, the serine residue at position 16 of native glucagon is substituted with an amino acid selected from the group consisting of glutamic acid, glutamine, homoglutamic acid and homocysteic acid, and in some embodiments the serine residue is substituted with glutamic acid.

In some embodiments, the enhanced potency Class 3 glucagon related peptide comprises a peptide of SEQ ID NO: 2, SEQ ID NO: 3, SEQ ID NO: 4, SEQ ID NO: 5, SEQ ID NO: 6, SEQ ID NO: 7 or a glucagon agonist analog of SEQ ID NO: 5. In accordance with some embodiments, a Class 3 glucagon related peptide having enhanced potency at the glucagon receptor relative to wild type glucagon is provided wherein the peptide comprises the sequence of SEQ ID NO: 7, SEQ ID NO: 8, SEQ ID NO: 9 or SEQ ID NO: 10, wherein the glucagon peptide retains its selectivity for the glucagon receptor relative to the GLP-1 receptors. In some embodiments, the Class 3 glucagon related peptide having enhanced specificity for the glucagon receptor comprises the peptide of SEQ ID NO: 8, SEQ ID NO: 9, SEQ ID NO: 10 or a glucagon agonist analog thereof, wherein the carboxy terminal amino acid retains its native carboxylic acid group. In accordance with some embodiments, a Class 3 glucagon related peptide comprises the sequence of NH$_2$-His-Ser-Gln-Gly-Thr-Phe-Thr-Ser-Asp-Tyr-Ser-Lys-Tyr-Leu-Asp-Glu-Arg-Arg-Ala-Gln-Asp-Phe-Val-Gln-Trp-Leu-Met-Asn-Thr-COOH (SEQ ID NO: 10), wherein the peptide exhibits approximately five-fold enhanced potency at the glucagon receptor, relative to native glucagon as measured by the in vitro cAMP assay of Example 5.

Glucagon receptor activity can be reduced, maintained, or enhanced by an amino acid modification at position 3, e.g. substitution of the naturally occurring glutamine at position 3. In some embodiments, substitution of the amino acid at position 3 with an acidic, basic, or hydrophobic amino acid (glutamic acid, ornithine, norleucine) has been shown to substantially reduce or destroy glucagon receptor activity. The analogs that are substituted with, for example, glutamic acid, ornithine, or norleucine have about 10% or less of the activity of native glucagon at the glucagon receptor, e.g. about 1-10%, or about 0.1-10%, or greater than about 0.1% but less than about 10%, while exhibiting at least 20% of the activity of GLP-1 at the GLP-1 receptor. For example, exemplary analogs described herein have about 0.5%, about 1% or about 7% of the activity of native glucagon, while exhibiting at least 20% of the activity of GLP-1 at the GLP-1 receptor. In particular, any of the Class 3 glucagon related peptides, including glucagon analogs, glucagon agonist analogs, glucagon co-agonists, and glucagon/GLP-1 co-agonist molecules, described herein may be modified to contain a modification at position 3, e.g., Gln substituted with Glu, to produce a peptide with high selectivity, e.g., tenfold selectivity, for the GLP-1 receptor as compared to the selectivity for the glucagon receptor.

In another embodiment, the naturally occurring glutamine at position 3 of any of the Class 3 glucagon peptides can be substituted with a glutamine analog without a substantial loss of activity at the glucagon receptor, and in some cases, with an enhancement of glucagon receptor activity, as described herein. In specific embodiments, the amino acid at position 3 is substituted with Dab(Ac). For example, glucagon agonists can comprise the amino acid sequence of SEQ ID NO: 595, SEQ ID NO: 601 SEQ ID NO: 603, SEQ ID NO: 604, SEQ ID NO: 605, and SEQ ID NO: 606.

It was observed that modifications at position 2 (e.g. AIB at position 2) and in some cases modifications at position 1 may reduce glucagon activity. This reduction in glucagon activity can be restored by stabilizing the alpha-helix in the C-terminal portion of glucagon, e.g. through means described herein, for example, through a covalent bond between the side chains of the amino acids at positions "i" and "i+4", e.g., 12 and 16, 16 and 20, or 20 and 24. In some embodiments, this covalent bond is a lactam bridge between a glutamic acid at position 16 and a lysine at position 20. In some embodiments, this covalent bond is an intramolecular bridge other than a lactam bridge. For example, suitable covalent bonding methods include any one or more of olefin metathesis, lanthionine-based cyclization, disulfide bridge or modified sulfur-containing bridge formation, the use of α,ω-diaminoalkane tethers, the formation of metal-atom bridges, and other means of peptide cyclization.

Modifications Affecting GLP-1 Activity

Enhanced activity at the GLP-1 receptor is provided by replacing the carboxylic acid of the C-terminal amino acid with a charge-neutral group, such as an amide or ester. In some embodiments, these Class 3 glucagon related peptides comprise a sequence of SEQ ID NO: 20, wherein the carboxy terminal amino acid has an amide group in place of the carboxylic acid group found on the native amino acid. These Class 3 glucagon related peptides have strong activity at both the glucagon and GLP-1 receptors and thus act as co-agonists at both receptors. In accordance with some embodiments, the Class 3 glucagon related peptide is a glucagon and GLP-1 receptor co-agonist, wherein the peptide comprises the sequence of SEQ ID NO: 20, wherein the amino acid at position 28 is Asn or Lys and the amino acid at position 29 is Thr-amide.

Increased activity at the GLP-1 receptor is provided by modifications that stabilize the alpha helix in the C-terminal portion of glucagon (e.g. around residues 12-29).

In some embodiments, such modifications permit formation of an intramolecular bridge between the side chains of two amino acids that are separated by three intervening amino acids (i.e., an amino acid at position "i" and an amino acid at position "i+4", wherein i is any integer between 12 and 25), by two intervening amino acids, i.e., an amino acid at position "j" and an amino acid at position "j+3," wherein j is any integer between 12 and 27, or by six intervening amino acids, i.e., an amino acid at position "k" and an amino acid at position "k+7," wherein k is any integer between 12 and 22. In exemplary embodiments, the bridge or linker is about 8 (or about 7-9) atoms in length and forms between side chains of amino acids at positions 12 and 16, or at positions 16 and 20, or at positions 20 and 24, or at positions 24 and 28. The two amino acid side chains can be linked to one another through non-covalent bonds, e.g., hydrogen-bonding, ionic interactions, such as the formation of salt bridges, or by covalent bonds.

In accordance with some embodiments, the Class 3 glucagon related peptide exhibits glucagon/GLP-1 receptor co-agonist activity and comprises an amino acid sequence selected from the group consisting of SEQ ID NO: 11, 47, 48 and 49. In some embodiments, the side chains are covalently bound to one another, and in some embodiments the two amino acids are bound to one another to form a lactam ring.

In accordance with some embodiments, the Class 3 glucagon related peptide comprises SEQ ID NO: 45, wherein at least one lactam ring is formed between the side chains of an amino acid pair selected from the group consisting of amino acid pairs 12 and 16, 16 and 20, and 24 or 24 and 28. In some embodiments, the Class 3 glucagon related peptide comprises a glucagon peptide analog of SEQ ID NO: 20, wherein the peptide comprises an intramolecular lactam bridge formed between amino acid positions 12 and 16 or between amino acid positions 16 and 20. In some embodiments, the Class 3 glucagon related peptide comprises the sequence of SEQ ID NO: 20, wherein an intramolecular lactam bridge is formed between amino acid positions 12 and 16, between amino acid positions 16 and 20, or between amino acid positions 20 and 24 and the amino acid at position 29 is glycine, wherein the sequence of SEQ ID NO: 29 is linked to the C-terminal amino acid of SEQ ID NO: 20. In a further embodiment, the amino acid at position 28 is aspartic acid.

In some specific embodiments, stabilization of the alpha helix structure in the C-terminal portion of the Class 3 glucagon related peptide is achieved through the formation of an intramolecular bridge other than a lactam bridge. For example, suitable covalent bonding methods include any one or more of olefin metathesis, lanthionine-based cyclization, disulfide bridge or modified sulfur-containing bridge formation, the use of α,ω-diaminoalkane tethers, the formation of metal-atom bridges, and other means of peptide cyclization are used to stabilize the alpha helix.

Furthermore, enhanced activity at the GLP-1 receptor may be achieved by stabilizing the alpha-helix structure in the C-terminal portion of the glucagon peptide (around amino acids 12-29) through purposeful introduction of one or more α,α-disubstituted amino acids at positions that retain the desired activity. Such peptides may be considered herein as a peptide lacking an intramolecular bridge. In some aspects, stabilization of the alpha-helix is accomplished in this manner without introduction of an intramolecular bridge such as a salt bridge or covalent bond. In some embodiments, one, two, three, four or more of positions 16, 17, 18, 19, 20, 21, 24 or 29 of a glucagon peptide is substituted with an α,α-disubstituted amino acid. For example, substitution of position 16 of the Class 3 glucagon related peptide with amino iso-butyric acid (AIB) enhances GLP-1 activity, in the absence of a salt bridge or lactam. In some embodiments, one, two, three or more of positions 16, 20, 21 or 24 are substituted with AIB.

Enhanced activity at the GLP-1 receptor may be achieved by an amino acid modification at position 20. In some embodiments, the glutamine at position 20 is replaced with another hydrophilic amino acid having a side chain that is either charged or has an ability to hydrogen-bond, and is at least about 5 (or about 4-6) atoms in length, for example, lysine, citrulline, arginine, or ornithine.

Increased activity at the GLP-1 receptor is demonstrated in Class 3 glucagon related peptides comprising the C-terminal extension of SEQ ID NO: 26. GLP-1 activity in such Class 3 glucagon related peptides comprising SEQ ID NO: 26 can be further increased by modifying the amino acid at position 18, 28 or 29, or at position 18 and 29, as described herein.

A further modest increase in GLP-1 potency may be achieved by modifying the amino acid at position 10 to be Trp.

Combinations of the modifications that increase GLP-1 receptor activity may provide higher GLP-1 activity than any of such modifications taken alone. For example, the Class 3 glucagon related peptides can comprise modifications at position 16, at position 20, and at the C-terminal carboxylic acid group, optionally with a covalent bond between the amino acids at positions 16 and 20; can comprise modifications at position 16 and at the C-terminal carboxylic acid group; can comprise modifications at positions 16 and 20, optionally with a covalent bond between the amino acids at positions 16 and 20; or can comprise modifications at position 20 and at the C-terminal carboxylic acid group; optionally with the proviso that the amino acid at position 12 is not Arg; or optionally with the proviso that the amino acid at position 9 is not Glu.

Modifications Affecting Solubility

Addition of Hydrophilic Moieties

The Class 3 glucagon related peptides can be further modified to improve the peptide's solubility and stability in aqueous solutions at physiological pH, while retaining the high biological activity relative to native glucagon. Hydrophilic moieties as discussed herein can be attached to the Class 3 glucagon related peptide as further discussed herein.

In accordance with some embodiments, introduction of hydrophilic groups at positions 17, 21, and 24 of the Class 3 glucagon related peptide comprising SEQ ID NO: 9 or SEQ ID NO: 10 are anticipated to improve the solubility and stability of the high potency glucagon analog in solutions having a physiological pH. Introduction of such groups also increases duration of action, e.g. as measured by a prolonged half-life in circulation.

In some embodiments, the Class 3 glucagon related peptide comprises a sequence selected from the group consisting of SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18 and SEQ ID NO: 19, wherein the side chain of an amino acid residue at one of position 16, 17, 21 or 24 of said Class 3 glucagon related peptide further comprises a polyethylene glycol chain, having a molecular weight selected from the range of about 500 to about 40,000 Daltons. In some embodiments, the polyethylene glycol chain has a molecular weight selected from the range of about 500 to about 5,000 Daltons. In another embodiment. the polyethylene glycol chain has a molecular weight of about 10,000 to about 20,000 Daltons. In yet other exemplary embodiments the polyethylene glycol chain has a molecular weight of about 20,000 to about 40,000 Daltons.

Suitable hydrophilic moieties include any water soluble polymers known in the art, including the hydrophilic moieties described herein, homo- or co-polymers of PEG, and a monomethyl-substituted polymer of PEG (mPEG). In accordance with some embodiments the hydrophilic group comprises a polyethylene (PEG) chain. More particularly, in some embodiments, the Class 3 glucagon related peptide comprises the sequence of SEQ ID NO: 6 or SEQ ID NO: 7 wherein a PEG chain is covalently linked to the side chains of amino acids present at positions 21 and 24 of the Class 3 glucagon related peptide and the carboxy terminal amino acid of the Class 3 glucagon related peptide has the carboxylic acid group. In accordance with some embodiments, the polyethylene glycol chain has an average molecular weight selected from the range of about 500 to about 10,000 Daltons.

In accordance with some embodiments, the pegylated Class 3 glucagon related peptide comprises two or more polyethylene glycol chains covalently bound to the Class 3 glucagon related peptide wherein the total molecular weight of the glucagon chains is about 1,000 to about 5,000 Daltons. In some embodiments the pegylated glucagon agonist comprises a peptide consisting of SEQ ID NO: 5 or a glucagon agonist analog of SEQ ID NO: 5, wherein a PEG chain is covalently linked to the amino acid residue at position 21 and at position 24, and wherein the combined molecular weight of the two PEG chains is about 1,000 to about 5,000 Daltons.

Charged C-Terminus

The solubility of the Class 3 glucagon related peptide comprising SEQ ID NO: 20 can be further improved, for example, by introducing one, two, three or more charged amino acid(s) to the C-terminal portion of glucagon peptide of SEQ ID NO: 20, preferably at a position C-terminal to position 27. Such a charged amino acid can be introduced by substituting a native amino acid with a charged amino acid, e.g. at positions 28 or 29, or alternatively by adding a charged amino acid, e.g. after position 27, 28 or 29. In exemplary embodiments, one, two, three or all of the charged amino acids are negatively charged. Additional modifications, e.g. conservative substitutions, may be made to the Class 3 glucagon related peptide that still allow it to retain glucagon activity. In some embodiments, an analog of the Class 3 glucagon related peptide of SEQ ID NO: 20 is provided wherein the analog differs from SEQ ID NO: 20 by 1 to 2 amino acid substitutions at positions 17-26, and, in some embodiments, the analog differs from the peptide of SEQ ID NO: 20 by an amino acid substitution at position 20.

Acylation/Alkylation

In accordance with some embodiments, the glucagon peptide is modified to comprise an acyl or alkyl group, e.g., a $C_4$ to $C_{30}$ acyl or alkyl group. In some aspects, the acyl group or alkyl group is not naturally occurring on an amino acid. In specific aspects, the acyl or alkyl group is non-native to any naturally-occurring amino acid. Acylation or alkylation can increase the half-life in circulation and/or delay the onset of and/or extend the duration of action and/or improve resistance to proteases such as DPP-IV. The activity at the glucagon receptor and GLP-1 receptor of the Class 3 glucagon related peptides is maintained, if not substantially enhanced after acylation Further, the potency of the acylated analogs were comparable to the unacylated versions of the Class 3 glucagon related peptides, if not substantially enhanced.

In some embodiments, the invention provides a Class 3 glucagon related peptide modified to comprise an acyl group or alkyl group covalently linked to the amino acid at position 10 of the glucagon peptide. The glucagon peptide may further comprise a spacer between the amino acid at position 10 of the Class 3 glucagon related peptide and the acyl group or alkyl group. Any of the foregoing Class 3 glucagon related peptides may comprise two acyl groups or two alkyl groups, or a combination thereof.

In a specific aspect of the invention, the acylated Class 3 glucagon related peptide comprises the amino acid sequence of any of SEQ ID NOs: 534-544 and 546-549.

C-Terminal Truncation

In some embodiments, the Class 3 glucagon related peptides described herein are further modified by truncation or deletion of one or two amino acids of the C-terminus of the glucagon peptide (i.e., position 29 and/or 28) without affecting activity and/or potency at the glucagon and GLP-1 receptors. In this regard, the Class 3 glucagon related peptide can comprise amino acids 1-27 or 1-28 of the native glucagon peptide (SEQ ID NO: 1), optionally with one or more modifications described herein.

In some embodiments, the truncated Class 3 glucagon related peptide comprises SEQ ID NO: 550 or SEQ ID NO: 551. In another embodiment, the truncated glucagon agonist peptide comprises SEQ ID NO: 552 or SEQ ID NO: 553.

C-Terminal Extension

In accordance with some embodiments, the Class 3 glucagon related peptides disclosed herein are modified by the addition of a second peptide to the carboxy terminus of the glucagon peptide, for example, SEQ ID NO: 26, SEQ ID NO: 27 or SEQ ID NO: 28. In some embodiments, a Class 3 glucagon related peptide having a sequence selected from the group consisting of SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 66, SEQ ID NO: 67, SEQ ID NO: 68, and SEQ ID NO: 69 is covalently bound through a peptide bond to a second peptide, wherein the second peptide comprises a sequence selected from the group consisting of SEQ ID NO: 26, SEQ ID NO: 27 and SEQ ID NO: 28. In a further embodiment, in Class 3 glucagon related peptides which comprise the C-terminal extension, the threonine at position 29 of the native glucagon peptide is replaced with a glycine. A Class 3 glucagon related peptide having a glycine substitution for threonine at position 29 and comprising the carboxy terminal extension of SEQ ID NO: 26 is four times as potent at the GLP-1 receptor as native glucagon modified to comprise the carboxy terminal extension of SEQ ID NO: 26. Potency at the GLP-1 receptor can be further enhanced by an alanine substitution for the native arginine at position 18.

Accordingly, the Class 3 glucagon related peptide can have a carboxy terminal extension of SEQ ID NO: 27 (KRNRNNIA) or SEQ ID NO: 28. In accordance with some embodiments, Class 3 glucagon related peptide comprising SEQ ID NO: 33 or SEQ ID NO: 20, further comprises the amino acid sequence of SEQ ID NO: 27 (KRNRNNIA) or SEQ ID NO: 28 linked to amino acid 29 of the glucagon peptide. More particularly, the Class 3 glucagon related peptide comprises a sequence selected from the group consisting of SEQ ID NO: 10, SEQ ID NO: 12, SEQ ID NO: 13 SEQ ID NO: 14 and SEQ ID NO: 15, further comprising the amino acid sequence of SEQ ID NO: 27 (KRNRNNIA) or SEQ ID NO: 28 linked to amino acid 29 of the glucagon peptide. More particularly, the glucagon peptide comprises a sequence selected from the group consisting of SEQ ID NO: 10, SEQ ID NO: 12, SEQ ID NO: 13 SEQ ID NO: 14, SEQ ID NO: 15, SEQ ID NO: 16, SEQ ID NO: 17, SEQ ID NO: 18, SEQ ID NO: 66, SEQ ID NO: 67, SEQ ID NO: 68, SEQ ID NO: 69, SEQ ID NO: 55 and SEQ ID NO: 56 further comprising the amino acid sequence of SEQ ID NO: 26 (GPSSGAPPPS) or SEQ ID NO: 29 linked to amino acid 29 of the Class 3 glucagon related peptide. In some embodiments, the Class 3 glucagon related peptide comprises the sequence of SEQ ID NO: 64.

Other Modifications

Any of the modifications described above with regard to Class 3 glucagon related peptides which increase or decrease glucagon receptor activity and which increase GLP-1 receptor activity can be applied individually or in combination. Combinations of the modifications that increase GLP-1 receptor activity generally provide higher GLP-1 activity than any of such modifications taken alone. Any of the modifications described above can also be combined with other modifications described herein in reference to Class 3 glucagon related peptides that confer other desirable properties, such as increased solubility and/or stability and/or duration of action. Alternatively, any of the modifications described above can be combined with other modifications described herein in reference to Class 3 glucagon related peptides that do not substantially affect solubility or stability or activity. Exemplary modifications include but are not limited to:

(A) Improving solubility, for example, by introducing one, two, three or more charged amino acid(s) to the C-terminal portion of native glucagon, preferably at a position C-terminal to position 27. Such a charged amino acid can be introduced by substituting a native amino acid with a charged amino acid, e.g. at positions 28 or 29, or alternatively by adding a charged amino acid, e.g. after position 27, 28 or 29. In exemplary embodiments, one, two, three or all of the charged amino acids are negatively charged. In other embodiments, one, two, three or all of the charged amino acids are positively charged. Such modifications increase solubility, e.g. provide at least 2-fold, 5-fold, 10-fold, 15-fold, 25-fold, 30-fold or greater solubility relative to native glucagon at a given pH between about 5.5 and 8, e.g., pH 7, when measured after 24 hours at 25° C.

(B) Increasing solubility and duration of action or half-life in circulation by addition of a hydrophilic moiety such as a polyethylene glycol chain, as described herein, e.g. at position 16, 17, 20, 21, 24 or 29, or at the C-terminal amino acid of the peptide.

(C) Increasing stability by modification of the aspartic acid at position 15, for example, by deletion or substitution with glutamic acid, homoglutamic acid, cysteic acid or homocysteic acid. Such modifications can reduce degradation or cleavage at a pH within the range of 5.5 to 8, especially in acidic or alkaline buffers, for example, retaining at least 75%, 80%, 90%, 95%, 96%, 97%, 98% or 99% of the original peptide after 24 hours at 25° C.

(D) Increasing stability by modification of the methionine at position 27, for example, by substitution with leucine or norleucine. Such modifications can reduce oxidative degradation. Stability can also be increased by modification of the Gln at position 20 or 24, e.g. by substitution with Ser, Thr, Ala or AIB. Such modifications can reduce degradation that occurs through deamidation of Gln. Stability can be increased by modification of Asp at position 21, e.g. by substitution with Glu. Such modifications can reduce degradation that occurs through dehydration of Asp to form a cyclic succinimide intermediate followed by isomerization to iso-aspartate.

(E) Increasing resistance to dipeptidyl peptidase IV (DPP IV) cleavage by modification of the amino acid at position 1 or 2 with the DPP-IV resistant amino acids described herein and including modification of the amino acid at position 2 with N-methyl-alanine.

(F) Conservative or non-conservative substitutions, additions or deletions that do not affect activity, for example, conservative substitutions at one or more of positions 2, 5, 7, 10, 11, 12, 13, 14, 16, 17, 18, 19, 20, 21, 24, 27, 28 or 29; deletions at one or more of positions 27, 28 or 29; or a deletion of amino acid 29 optionally combined with a C-terminal amide or ester in place of the C-terminal carboxylic acid group;

(G) Adding C-terminal extensions as described herein;

(H) Increasing half-life in circulation and/or extending the duration of action and/or delaying the onset of action, for example, through acylation or alkylation of the glucagon peptide, as described herein;

(I) Homodimerization or heterodimerization as described herein.

Other modifications include substitution of His at position 1 with a large, aromatic amino acid (e.g., Tyr, Phe, Trp or amino-Phe); Ser at position 2 with Ala; substitution of Tyr at position 10 with Val or Phe; substitution of Lys at position 12 with Arg; substitution of Asp at position 15 with Glu; substitution of Ser at position 16 with Thr or AIB.

Class 3 glucagon related peptides with GLP-1 activity that contain a non-conservative substitution of His at position 1 with a large, aromatic amino acid (e.g., Tyr) can retain GLP-1 activity provided that the alpha-helix is stabilized via an intramolecular bridge, e.g., such as any of those described herein.

Conjugates and Fusions

The Class 3 glucagon related peptide can be linked, optionally via covalent bonding and optionally via a linker, to a conjugate moiety.

The Class 3 glucagon related peptide also can be part of a fusion peptide or protein wherein a second peptide or polypeptide has been fused to a terminus, e.g., the carboxy terminus of the Class 3 glucagon related peptide.

More particularly, the fusion Class 3 glucagon related peptide may comprise a glucagon agonist of SEQ ID NO: 55, SEQ ID NO: 9 or SEQ ID NO: 10 further comprising an amino acid sequence of SEQ ID NO: 26 (GPSSGAPPPS), SEQ ID NO: 27 (KRNRNNIA) or SEQ ID NO: 28 (KRNR) linked to amino acid 29 of the glucagon peptide. In some embodiments, the amino acid sequence of SEQ ID NO: 26 (GPSSGAPPPS), SEQ ID NO: 27 (KRNRNNIA) or SEQ ID NO: 28 (KRNR) is bound to amino acid 29 of the Class 3 glucagon related peptide through a peptide bond. Applicants have discovered that in Class 3 glucagon related peptide fusion peptides comprising the C-terminal extension peptide of Exendin-4 (e.g., SEQ ID NO: 26 or SEQ ID NO: 29), substitution of the native threonine residue at position 29 with glycine dramatically increases GLP-1 receptor activity. This amino acid substitution can be used in conjunction with other modifications disclosed herein with regard to Class 3 glucagon related peptides to enhance the affinity of the glucagon analogs for the GLP-1 receptor. For example, the T29G substitution can be combined with the S16E and N20K amino acid substitutions, optionally with a lactam bridge between amino acids 16 and 20, and optionally with addition of a PEG chain as described herein. In some embodiments, a Class 3 glucagon related peptide comprises the sequence of SEQ ID NO: 64. In some embodiments, the Class 3 glucagon related peptide portion of the glucagon fusion peptide is selected from the group consisting of SEQ ID NO: 55, SEQ ID NO: 2, SEQ ID NO: 3, SEQ ID NO: 4, and SEQ ID NO: 5 wherein a PEG chain, when present at positions 17, 21, 24, or the C-terminal amino acid, or at both 21 and 24, is selected from the range of 500 to 40,000 Daltons. More particularly, in some embodiments, the Class 3 glucagon related peptide segment is selected from the group consisting of SEQ ID NO: 7, SEQ ID NO: 8, and SEQ ID NO: 63, wherein the PEG chain is selected from the range of 500 to 5,000. In some embodiments, the Class 3 glucagon related peptide is a fusion peptide comprising the sequence of SEQ ID NO: 55 and SEQ ID NO: 65 wherein the peptide of SEQ ID NO: 65 is linked to the carboxy terminus of SEQ ID NO: 55.

In accordance with some embodiments, an additional chemical modification of the Class 3 glucagon related peptide of SEQ ID NO: 10 bestows increased GLP-1 receptor potency to a point where the relative activity at the glucagon and GLP-1 receptors is virtually equivalent. Accordingly, in some embodiments, a Class 3 glucagon related peptide comprises a terminal amino acid comprising an amide group in place of the carboxylic acid group that is present on the native amino acid. The relative activity of the Class 3 glucagon related peptide at the respective glucagon and GLP-1 receptors can be adjusted by further modifications to the Class 3 glucagon related peptide to produce analogs demonstrating about 40% to about 500% or more of the activity of native glucagon at the glucagon receptor and about 20% to about 200% or more of the activity of native GLP-1 at the GLP-1 receptor, e.g. 50-fold, 100-fold or more increase relative to the normal activity of glucagon at the GLP-1 receptor. In some embodiments, the glucagon peptides described herein exhibit up to about 100%, 1000%, 10,000%, 100,000%, or 1,000,000% of the activity of native glucagon at the glucagon receptor. In some embodiments, the glucagon peptides described herein exhibit up to about 100%, 1000%, 10,000%, 100,000%, or 1,000,000% of the activity of native GLP-1 at the GLP-1 receptor.

Exemplary Embodiments

In accordance with some embodiments, a glucagon analog is provided comprising the sequence of SEQ ID NO: 55, wherein said analog differs from SEQ ID NO: 55 by 1 to 3 amino acids, selected from positions 1, 2, 3, 5, 7, 10, 11, 13, 14, 17, 18, 19, 21, 24, 27, 28, and 29, wherein said glucagon peptide exhibits at least 20% of the activity of native GLP-1 at the GLP-1 receptor.

In accordance with some embodiments a glucagon/GLP-1 receptor co-agonist is provided comprising the sequence: NH₂-His-Ser-Gln-Gly-Thr-Phe-Thr-Ser-Asp-Tyr-Ser-Lys-Tyr-Leu-Xaa-Xaa-Arg-Arg-Ala-Xaa-Asp-Phe-Val-Xaa-Trp-Leu-Met-Xaa-Xaa-R (SEQ ID NO: 33) wherein the Xaa at position 15 is selected from the group of amino acids consisting of Asp, Glu, cysteic acid, homoglutamic acid and homocysteic acid, Xaa at position 16 is selected from the group of amino acids consisting of Ser, Glu, Gln, homoglutamic acid and homocysteic acid, the Xaa at position 20 is Gln or Lys, the Xaa at position 24 is Gln or Glu, the Xaa at position 28 is Asn, Lys or an acidic amino acid, the Xaa at position 29 is Thr, Gly or an acidic amino acid, and R is COOH or CONH₂, with the proviso that when position 16 is serine, position 20 is Lys, or alternatively when position 16 is serine the position 24 is Glu and either position 20 or position 28 is Lys. In some embodiments the glucagon/GLP-1 receptor co-agonist comprises the sequence of SEQ ID NO: 33 wherein the amino acid at position 28 is aspartic acid and the amino acid at position 29 is glutamic acid. In another embodiment the amino acid at position 28 is the native asparagine, the amino acid at position 29 is glycine and the amino acid sequence of SEQ ID NO: 29 or SEQ ID NO: 65 is covalently linked to the carboxy terminus of SEQ ID NO: 33.

In some embodiments a co-agonist is provided comprising the sequence of SEQ ID NO: 33 wherein an additional acidic amino acid added to the carboxy terminus of the peptide. In a further embodiment the carboxy terminal amino acid of the glucagon analog has an amide in place of the carboxylic acid group of the natural amino acid. In some embodiments the glucagon analog comprises a sequence selected from the group consisting of SEQ ID NO: 40, SEQ ID NO: 41, SEQ ID NO: 42, SEQ ID NO: 43 and SEQ ID NO: 44.

In accordance with some embodiments a glucagon peptide analog of SEQ ID NO: 33 is provided, wherein said analog differs from SEQ ID NO: 33 by 1 to 3 amino acids, selected from positions 1, 2, 3, 5, 7, 10, 11, 13, 14, 17, 18, 19, 21 and 27, with the proviso that when the amino acid at position 16 is serine, either position 20 is lysine, or a lactam bridge is formed between the amino acid at position 24 and either the amino acid at position 20 or position 28. In accordance with some embodiments the analog differs from SEQ ID NO: 33 by 1 to 3 amino acids selected from positions 1, 2, 3, 21 and 27. In some embodiments the glucagon peptide analog of SEQ ID NO: 33 differs from that sequence by 1 to 2 amino acids, or in some embodiments by a single amino acid, selected form positions 1, 2, 3, 5, 7, 10, 11, 13, 14, 17, 18, 19, 21 and 27, with the proviso that when the amino acid at position 16 is serine, either position 20 is lysine, or a lactam bridge is formed between the amino acid at position 24 and either the amino acid at position 20 or position 28.

In accordance with another embodiment a relatively selective GLP-1 receptor agonist is provided comprising the sequence NH₂-His-Ser-Xaa-Gly-Thr-Phe-Thr-Ser-Asp-Tyr-Ser-Lys-Tyr-Leu-Xaa-Xaa-Arg-Arg-Ala-Xaa-Asp-Phe-Val-Xaa-Trp-Leu-Met-Xaa-Xaa-R (SEQ ID NO: 53) wherein the Xaa at position 3 is selected from the group of amino acids consisting of Glu, Orn or Nle, the Xaa at position 15 is selected from the group of amino acids consisting of Asp, Glu, cysteic acid, homoglutamic acid and homocysteic acid, Xaa at position 16 is selected from the group of amino acids consisting of Ser, Glu, Gln, homoglutamic acid and homocysteic acid, the Xaa at position 20 is Gln or Lys, the Xaa at position 24 is Gln or Glu, the Xaa at position 28 is Asn, Lys or an acidic amino acid, the Xaa at position 29 is Thr, Gly or an acidic amino acid, and R is COOH, CONH₂, SEQ ID NO: 26 or SEQ ID NO: 29, with the proviso that when position 16 is serine, position 20 is Lys, or alternatively when position 16 is serine the position 24 is Glu and either position 20 or position 28 is Lys. In some embodiments the amino acid at position 3 is glutamic acid. In some embodiments the acidic amino acid substituted at position 28 and/or 29 is aspartic acid or glutamic acid. In some embodiments the glucagon peptide, including a co-agonist peptide, comprises the sequence of SEQ ID NO: 33 further comprising an additional acidic amino acid added to the carboxy terminus of the peptide. In a further embodiment the carboxy terminal amino acid of the glucagon analog has an amide in place of the carboxylic acid group of the natural amino acid.

In accordance with some embodiments a glucagon/GLP-1 receptor co-agonist is provided comprising a modified glucagon peptide selected from the group consisting of: NH₂-His-Ser-Gln-Gly-Thr-Phe-Thr-Ser-Asp-Tyr-Ser-Lys-Tyr-Leu-Xaa-Xaa-Arg-Arg-Ala-Xaa-Asp-Phe-Val-Xaa-Trp-Leu-Met-Xaa-Xaa-R (SEQ ID NO: 34), wherein the Xaa at position 15 is selected from the group of amino acids consisting of Asp, Glu, cysteic acid, homoglutamic acid and homocysteic acid, Xaa at position 16 is selected from the group of amino acids consisting of Ser, Glu, Gln, homoglutamic acid and homocysteic acid, the Xaa at position 20 is Gln or Lys, the Xaa at position 24 is Gln or Glu and the Xaa at position 28 is Asn, Asp or Lys, R is COOH or CONH$_2$, the Xaa at position 29 is Thr or Gly, and R is COOH, CONH$_2$, SEQ ID NO: 26 or SEQ ID NO: 29, with the proviso that when position 16 is serine, position 20 is Lys, or alternatively when position 16 is serine the position 24 is Glu and either position 20 or position 28 is Lys. In some embodiments R is CONH$_2$, the Xaa at position 15 is Asp, the Xaa at position 16 is selected from the group of amino acids consisting of Glu, Gln, homoglutamic acid and homocysteic acid, the Xaas at positions 20 and 24 are each Gln the Xaa at position 28 is Asn or Asp and the Xaa at position 29 is Thr. In some embodiments the Xaas at positions 15 and 16 are each Glu, the Xaas at positions 20 and 24 are each Gln, the Xaa at position 28 is Asn or Asp, the Xaa at position 29 is Thr and R is CONH$_2$.

It has been reported that certain positions of the native glucagon peptide can be modified while retaining at least some of the activity of the parent peptide. Accordingly, applicants anticipate that one or more of the amino acids located at positions at positions 2, 5, 7, 10, 11, 12, 13, 14, 17, 18, 19, 20, 21, 24, 27, 28 or 29 of the peptide of SEQ ID NO: 11 can be substituted with an amino acid different from that present in the native glucagon peptide, and still retain activity at the glucagon receptor. In some embodiments the methionine residue present at position 27 of the native peptide is changed to leucine or norleucine to prevent oxidative degradation of the peptide. In another embodiment the amino acid at position 20 is substituted with Lys, Arg, Orn or Citrullene and/or position 21 is substituted with Glu, homoglutamic acid or homocysteic acid.

In some embodiments a glucagon analog of SEQ ID NO: 20 is provided wherein 1 to 6 amino acids, selected from positions 1, 2, 5, 7, 10, 11, 13, 14, 17, 18, 19, 21, 27, 28 or 29 of the analog differ from the corresponding amino acid of SEQ ID NO: 1, with the proviso that when the amino acid at position 16 is serine, position 20 is Lys, or alternatively when position 16 is serine the position 24 is Glu and either position 20 or position 28 is Lys. In accordance with another embodiment a glucagon analog of SEQ ID NO: 20 is provided wherein 1 to 3 amino acids selected from positions 1, 2, 5, 7, 10, 11, 13, 14, 17, 18, 19, 20, 21, 27, 28 or 29 of the analog differ from the corresponding amino acid of SEQ ID NO: 1. In another embodiment, a glucagon analog of SEQ ID NO: 8, SEQ ID NO: 9 or SEQ ID NO: 11 is provided wherein 1 to 2 amino acids selected from positions 1, 2, 5, 7, 10, 11, 13, 14, 17, 18, 19, 20 or 21 of the analog differ from the corresponding amino acid of SEQ ID NO: 1, and in a further embodiment the one to two differing amino acids represent conservative amino acid substitutions relative to the amino acid present in the native glucagon sequence (SEQ ID NO: 1). In some embodiments a glucagon peptide of SEQ ID NO: 12, SEQ ID NO: 13, SEQ ID NO: 14 or SEQ ID NO: 15 is provided wherein the glucagon peptide further comprises one, two or three amino acid substitutions at positions selected from positions 2, 5, 7, 10, 11, 13, 14, 17, 18, 19, 20, 21, 27 or 29. In some embodiments the substitutions at positions 2, 5, 7, 10, 11, 13, 14, 16, 17, 18, 19, 20, 21, 27 or 29 are conservative amino acid substitutions.

In accordance with some embodiments a glucagon/GLP-1 receptor co-agonist is provided comprising a variant of the sequence of SEQ ID NO 33, wherein 1 to 10 amino acids selected from positions 16, 17, 18, 20, 21, 23, 24, 27, 28 and 29, respectively, of the variant differ from the corresponding amino acid of SEQ ID NO: 1. In accordance with some embodiments a variant of the sequence of SEQ ID NO 33 is provided wherein the variant differs from SEQ ID NO: 33 by one or more amino acid substitutions selected from the group consisting of Gln17, Ala18, Glu21, Ile23, Ala24, Val27 and Gly29. In accordance with some embodiments a glucagon/GLP-1 receptor co-agonist is provided comprising variants of the sequence of SEQ ID NO 33, wherein 1 to 2 amino acids selected from positions 17-26 of the variant differ from the corresponding amino acid of SEQ ID NO: 1. In accordance with some embodiments a variant of the sequence of SEQ ID NO 33 is provided wherein the variant differs from SEQ ID NO: 33 by an amino acid substitution selected from the group consisting of Gln17, Ala18, Glu21, Ile23 and Ala24. In accordance with some embodiments a variant of the sequence of SEQ ID NO 33 is provided wherein the variant differs from SEQ ID NO: 33 by an amino acid substitution at position 18 wherein the substituted amino acid is selected from the group consisting of Ala, Ser, Thr, and Gly. In accordance with some embodiments a variant of the sequence of SEQ ID NO 33 is provided wherein the variant differs from SEQ ID NO: 33 by an amino acid substitution of Ala at position 18. Such variations are encompassed by SEQ ID NO: 55. In another embodiment a glucagon/GLP-1 receptor co-agonist is provided comprising variants of the sequence of SEQ ID NO 33, wherein 1 to 2 amino acids selected from positions 17-22 of the variant differ from the corresponding amino acid of SEQ ID NO: 1, and in a further embodiment a variant of SEQ ID NO 33 is provided wherein the variant differs from SEQ ID NO: 33 by 1 or 2 amino acid substitutions at positions 20 and 21. In accordance with some embodiments a glucagon/GLP-1 receptor co-agonist is provided comprising the sequence: NH2-His-Ser-Gln-Gly-Thr-Phe-Thr-Ser-Asp-Tyr-Ser-Lys-Tyr-Leu-Xaa-Xaa-Arg-Arg-Ala-Xaa-Xaa-Phe-Val-Xaa-Trp-Leu-Met-Xaa-Xaa-R (SEQ ID NO: 51), wherein the Xaa at position 15 is Asp, Glu, cysteic acid, homoglutamic acid or homocysteic acid, the Xaa at position 16 is Ser, Glu, Gln, homoglutamic acid or homocysteic acid, the Xaa at position 20 is Gln, Lys, Arg, Orn or citrulline, the Xaa at position 21 is Asp, Glu, homoglutamic acid or homocysteic acid, the Xaa at position 24 is Gln or Glu, the Xaa at position 28 is Asn, Lys or an acidic amino acid, the Xaa at position 29 is Thr or an acid amino acid and R is COOH or CONH$_2$. In some embodiments R is CONH$_2$. In accordance with some embodiments a glucagon/GLP-1 receptor co-agonist is provided comprising a variant of SEQ ID NO: 11, SEQ ID NO: 12, SEQ ID NO: 13, SEQ ID NO: 14, SEQ ID NO: 15, SEQ ID NO: 47, SEQ ID NO: 48 or SEQ ID NO: 49, wherein the variant differs from said sequence by an amino acid substitution at position 20. In some embodiments the amino acid substitution is selected form the group consisting of Lys, Arg, Orn or citrulline for position 20.

In some embodiments a glucagon agonist is provided comprising an analog peptide of SEQ ID NO: 34 wherein the analog differs from SEQ ID NO: 34 by having an amino acid other than serine at position 2. In some embodiments the serine residue is substituted with aminoisobutyric acid, D-alanine, and in some embodiments the serine residue is substituted with aminoisobutyric acid. Such modifications suppresses cleavage by dipeptidyl peptidase IV while retaining the inherent potency of the parent compound (e.g. at least 75, 80, 85, 90, 95% or more of the potentcy of the parent compound). In some embodiments the solubility of the analog is increased, for example, by introducing one, two, three or more charged amino acid(s) to the C-terminal portion of native glucagon, preferably at a position C-terminal to position 27. In exemplary embodiments, one, two, three or all of the charged amino acids are negatively charged. In another embodiment the analog further comprises an acidic amino acid substituted for the native amino acid at position 28 or 29 or an acidic amino acid added to the carboxy terminus of the peptide of SEQ ID NO: 34.

In some embodiments the glucagon analogs disclosed herein are further modified at position 1 or 2 to reduce susceptibility to cleavage by dipeptidyl peptidase IV. In some embodiments a glucagon analog of SEQ ID NO: 9, SEQ ID NO: 11, SEQ ID NO: 12, SEQ ID NO: 13, SEQ ID NO: 14 or SEQ ID NO: 15 is provided wherein the analog differs from the parent molecule by a substitution at position 2 and exhibits reduced susceptibility (i.e., resistance) to cleavage by dipeptidyl peptidase IV. More particularly, in some embodiments position 2 of the analog peptide is substituted with an amino acid selected from the group consisting of D-serine, D-alanine, valine, amino n-butyric acid, glycine, N-methyl serine and aminoisobutyric acid. In some embodiments position 2 of the analog peptide is substituted with an amino acid selected from the group consisting of D-serine, D-alanine, glycine, N-methyl serine and aminoisobutyric acid. In another embodiment position 2 of the analog peptide is substituted with an amino acid selected from the group consisting of D-serine, glycine, N-methyl serine and aminoisobutyric acid. In some embodiments the amino acid at position 2 is not D-serine. In some embodiments the glucagon peptide comprises the sequence of SEQ ID NO: 21 or SEQ ID NO: 22.

In some embodiments a glucagon analog of SEQ ID NO: 9, SEQ ID NO: 11, SEQ ID NO: 12, SEQ ID NO: 13, SEQ ID NO: 14 or SEQ ID NO: 15 is provided wherein the analog differs from the parent molecule by a substitution at position 1 and exhibits reduced susceptibility (i.e., resistance) to cleavage by dipeptidyl peptidase IV. More particularly, position 1 of the analog peptide is substituted with an amino acid selected from the group consisting of D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine. In another embodiment a glucagon agonist is provided comprising an analog peptide of SEQ ID NO: 34 wherein the analog differs from SEQ ID NO: 34 by having an amino acid other than histidine at position 1. In some embodiments the solubility of the analog is increased, for example, by introducing one, two, three or more charged amino acid(s) to the C-terminal portion of native glucagon, preferably at a position C-terminal to position 27. In exemplary embodiments, one, two, three or all of the charged amino acids are negatively charged. In another embodiment the analog further comprises an acidic amino acid substituted for the native amino acid at position 28 or 29 or an acidic amino acid added to the carboxy terminus of the peptide of SEQ ID NO: 34. In some embodiments the acidic amino acid is aspartic acid or glutamic acid.

In some embodiments the glucagon/GLP-1 receptor co-agonist comprises a sequence of SEQ ID NO: 20 further comprising an additional carboxy terminal extension of one amino acid or a peptide selected from the group consisting of SEQ ID NO: 26, SEQ ID NO: 27 and SEQ ID NO: 28. In the embodiment wherein a single amino acid is added to the carboxy terminus of SEQ ID NO: 20, the amino acid is typically selected from one of the 20 common amino acids, and in some embodiments the additional carboxy terminus amino acid has an amide group in place of the carboxylic acid of the native amino acid. In some embodiments the additional amino acid is selected from the group consisting of glutamic acid, aspartic acid and glycine.

In an alternative embodiment a glucagon/GLP-1 receptor co-agonist is provided wherein the peptide comprises at least one lactam ring formed between the side chain of a glutamic acid residue and a lysine residue, wherein the glutamic acid residue and a lysine residue are separated by three amino acids. In some embodiments the carboxy terminal amino acid of the lactam bearing glucagon peptide has an amide group in place of the carboxylic acid of the native amino acid. More particularly, in some embodiments a glucagon and GLP-1 co-agonist is provided comprising a modified glucagon peptide selected from the group consisting of:

(SEQ ID NO: 66)
NH$_2$-His-Ser-Gln-Gly-Thr-Phe-Thr-Ser-Asp-Tyr-Ser-Lys-Tyr-Leu-Asp-Glu-Arg-Arg-Ala-Gln-Asp-Phe-Val-Gln-Trp-Leu-Met-Xaa-Xaa-R (SEQ ID NO: 67)
NH$_2$-His-Ser-Gln-Gly-Thr-Phe-Thr-Ser-Asp-Tyr-Ser-Lys-Tyr-Leu-Asp-Glu-Arg-Arg-Ala-Lys-Asp-Phe-Val-Gln-Trp-Leu-Met-Xaa-Xaa-R (SEQ ID NO: 68)
NH$_2$-His-Ser-Gln-Gly-Thr-Phe-Thr-Ser-Asp-Tyr-Ser-Lys-Tyr-Leu-Asp-Ser-Arg-Arg-Ala-Lys-Asp-Phe-Val-Glu-Trp-Leu-Met-Xaa-Xaa-R (SEQ ID NO: 69)
NH$_2$-His-Ser-Gln-Gly-Thr-Phe-Thr-Ser-Asp-Tyr-Ser-Lys-Tyr-Leu-Asp-Ser-Arg-Arg-Ala-Gln-Asp-Phe-Val-Glu-Trp-Leu-Met-Lys-Xaa-R (SEQ ID NO: 16)
NH$_2$-His-Ser-Gln-Gly-Thr-Phe-Thr-Ser-Asp-Tyr-Ser-Lys-Tyr-Leu-Asp-Glu-Arg-Arg-Ala-Lys-Asp-Phe-Val-Glu-Trp-Leu-Met-Asn-Thr-R (SEQ ID NO: 17)
NH$_2$-His-Ser-Gln-Gly-Thr-Phe-Thr-Ser-Asp-Tyr-Ser-Lys-Tyr-Leu-Asp-Glu-Arg-Arg-Ala-Gln-Asp-Phe-Val-Glu-Trp-Leu-Met-Lys-Thr-R (SEQ ID NO: 18)
NH$_2$-His-Ser-Gln-Gly-Thr-Phe-Thr-Ser-Asp-Tyr-Ser-Lys-Tyr-Leu-Asp-Glu-Arg-Arg-Ala-Lys-Asp-Phe-Val-Glu-Trp-Leu-Met-Lys-Thr-R wherein Xaa at position 28=Asp, or Asn, the Xaa at position 29 is Thr or Gly, R is selected from the group consisting of COOH, CONH$_2$, glutamic acid, aspartic acid, glycine, SEQ ID NO: 26, SEQ ID NO: 27 and SEQ ID NO: 28, and a lactam bridge is formed between Lys at position 12 and Glu at position 16 for SEQ ID NO: 66, between Glu at position 16 and Lys at position 20 for SEQ ID NO: 67, between Lys at position 20 and Glu at position 24 for SEQ ID NO: 68, between Glu at position 24 and Lys at position 28 for SEQ ID NO: 69, between Lys at position 12 and Glu at position 16 and between Lys at position 20 and Glu at position 24 for SEQ ID NO: 16, between Lys at position 12 and Glu at position 16 and between Glu at position 24 and Lys at position 28 for SEQ ID NO: 17 and between Glu at position 16 and Lys at position 20 and between Glu at position 24 and Lys at position 28 for SEQ ID NO: 18. In some embodiments R is selected from the group consisting of COOH, CONH$_2$, glutamic acid, aspartic acid, glycine, the amino acid at position 28 is Asn, and the amino acid at position 29 is threonine. In some embodiments R is CONH$_2$, the amino acid at position 28 is Asn and the amino acid at position 29 is threonine. In another embodiment R is selected from the group consisting of SEQ ID NO: 26, SEQ ID NO: 29 and SEQ ID NO: 65 and the amino acid at position 29 is glycine.

In a further embodiment the glucagon/GLP-1 receptor co-agonist is selected from the group consisting of SEQ ID NO: 11, SEQ ID NO: 12, SEQ ID NO: 13, SEQ ID NO: 14, SEQ ID NO: 15, SEQ ID NO: 16, SEQ ID NO: 17 and SEQ ID NO: 18, wherein the peptide further comprises an additional carboxy terminal extension of one amino acid or a peptide selected from the group consisting of SEQ ID NO: 26, SEQ ID NO: 27 and SEQ ID NO: 28. In some embodiments the terminal extension comprises the sequence of SEQ ID NO: 26, SEQ ID NO: 29 or SEQ ID NO: 65 and the glucagon peptide comprises the sequence of SEQ ID NO: 55. In some embodiments the glucagon/GLP-1 receptor co-agonist comprises the sequence of SEQ ID NO: 33 wherein the amino acid at position 16 is glutamic acid, the amino acid at position 20 is lysine, the amino acid at position 28 is asparagine and the amino acid sequence of SEQ ID No: 26 or SEQ ID NO: 29 is linked to the carboxy terminus of SEQ ID NO: 33.

In the embodiment wherein a single amino acid is added to the carboxy terminus of SEQ ID NO: 20, the amino acid is typically selected from one of the 20 common amino acids, and in some embodiments the amino acid has an amide group in place of the carboxylic acid of the native amino acid. In some embodiments the additional amino acid is selected from the group consisting of glutamic acid and aspartic acid and glycine. In the embodiments wherein the glucagon agonist analog further comprises a carboxy terminal extension, the carboxy terminal amino acid of the extension, in some embodiments, ends in an amide group or an ester group rather than a carboxylic acid.

In another embodiment the glucagon/GLP-1 receptor co-agonist comprises the sequence: NH$_2$-His-Ser-Gln-Gly-Thr-Phe-Thr-Ser-Asp-Tyr-Ser-Lys-Tyr-Leu-Asp-Glu-Arg-Arg-Ala-Gln-Asp-Phe-Val-Gln-Trp-Leu-Met-Asn-Thr-Xaa-CONH$_2$ (SEQ ID NO: 19), wherein the Xaa at position 30 represents any amino acid. In some embodiments Xaa is selected from one of the 20 common amino acids, and in some embodiments the amino acid is glutamic acid, aspartic acid or glycine. The solubility of this peptide can be further improved by covalently linking a PEG chain to the side chain of amino acid at position 17, 21, 24 or 30 of SEQ ID NO: 19. In a further embodiment the peptide comprises an additional carboxy terminal extension of a peptide selected from the group consisting of SEQ ID NO: 26, SEQ ID NO: 27 and SEQ ID NO: 28. In accordance with some embodiments the glucagon/GLP-1 receptor co-agonist comprises the sequence of SEQ ID NO: 30, SEQ ID NO: 31 and SEQ ID NO: 32.

Additional site specific modifications internal to the glucagon sequence of SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19 and SEQ ID NO: 64 can be made to yield a set of glucagon agonists that possess variable degrees of GLP-1 agonism. Accordingly, peptides that possess virtually identical in vitro potency at each receptor have been prepared and characterized. Similarly, peptides with tenfold selectively enhanced potency at each of the two receptors have been identified and characterized. As noted above substitution of the serine residue at position 16 with glutamic acid enhances the potency of native glucagon at both the Glucagon and GLP-1 receptors, but maintains approximately a tenfold selectivity for the glucagon receptor. In addition by substituting the native glutamine at position 3 with glutamic acid (SEQ ID NO: 22) generates a glucagon analog that exhibits approximately a tenfold selectivity for the GLP-1 receptor.

The solubility of the glucagon/GLP-1 co-agonist peptides can be further enhanced in aqueous solutions at physiological pH, while retaining the high biological activity relative to native glucagon by the introduction of hydrophilic groups at positions 16, 17, 21, and 24 of the peptide, or by the addition of a single modified amino acid (i.e., an amino acid modified to comprise a hydrophilic group) at the carboxy terminus of the glucagon/GLP-1 co-agonist peptide. In accordance with some embodiments the hydrophilic group comprises a polyethylene (PEG) chain. More particularly, in some embodiments the glucagon peptide comprises the sequence of SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17 or SEQ ID NO: 18 wherein a PEG chain is covalently linked to the side chain of an amino acids at position 16, 17, 21, 24, 29 or the C-terminal amino acid of the glucagon peptide, with the proviso that when the peptide comprises SEQ ID NO: 10, SEQ ID NO: 11, SEQ ID NO: 12 or SEQ ID NO: 13 the polyethylene glycol chain is covalently bound to an amino acid residue at position 17, 21 or 24, when the peptide comprises SEQ ID NO: 14 or SEQ ID NO: 15 the polyethylene glycol chain is covalently bound to an amino acid residue at position 16, 17 or 21, and when the peptide comprises SEQ ID NO: 16, SEQ ID NO: 17 or SEQ ID NO: 18 the polyethylene glycol chain is covalently bound to an amino acid residue at position 17 or 21.

In some embodiments the glucagon peptide comprises the sequence of SEQ ID NO: 11, SEQ ID NO: 12 or SEQ ID NO: 13, wherein a PEG chain is covalently linked to the side chain of an amino acids at position 17, 21, 24, or the C-terminal amino acid of the glucagon peptide, and the carboxy terminal amino acid of the peptide has an amide group in place of the carboxylic acid group of the native amino acid. In some embodiments the glucagon/GLP-1 receptor co-agonist peptide comprises a sequence selected from the group consisting of SEQ ID NO: 12, SEQ ID NO: 13, SEQ ID NO: 14, SEQ ID NO: 15, SEQ ID NO: 16, SEQ ID NO: 17, SEQ ID NO: 18 and SEQ ID NO: 19, wherein a PEG chain is covalently linked to the side chain of an amino acid at position 17, 21 or 24 of SEQ ID NO: 12, SEQ ID NO: 13 and SEQ ID NO: 19, or at position 16, 17 or 21 of SEQ ID NO: 14 and SEQ ID NO: 15 or at position 17 or 21 of SEQ ID NO: 16, SEQ ID NO: 17 and SEQ ID NO: 18 of the glucagon peptide. In another embodiment the glucagon/GLP-1 receptor co-agonist peptide comprises the sequence of SEQ ID NO: 11 or SEQ ID NO: 19, wherein a PEG chain is covalently linked to the side chain of an amino acids at position 17, 21 or 24 or the C-terminal amino acid of the glucagon peptide.

In accordance with some embodiments, and subject to the proviso limitations described in the preceding paragraphs, the glucagon co-agonist peptide is modified to contain one or more amino acid substitution at positions 16, 17, 21, 24, or 29 or the C-terminal amino acid, wherein the native amino acid is substituted with an amino acid having a side chain suitable for crosslinking with hydrophilic moieties, including for example, PEG. The native peptide can be substituted with a naturally occurring amino acid or a synthetic (non-naturally occurring) amino acid. Synthetic or non-naturally occurring amino acids refer to amino acids that do not naturally occur in vivo but which, nevertheless, can be incorporated into the peptide structures described herein. Alternatively, the amino acid having a side chain suitable for crosslinking with hydrophilic moieties, including for example, PEG, can be added to the carboxy terminus of any of the glucagon analogs disclosed herein. In accordance with some embodiments an amino acid substitution is made in the glucagon/GLP-1 receptor co-agonist peptide at a position selected from the group consisting of 16, 17, 21, 24, or 29 replacing the native amino acid with an amino acid selected from the group consisting of lysine, cysteine, ornithine, homocysteine and acetyl phenylalanine, wherein the substituting amino acid further comprises a PEG chain covalently bound to the side chain of the amino acid. In some embodiments a glucagon peptide selected form the group consisting of SEQ ID NO: 12, SEQ ID NO: 13, SEQ ID NO: 14, SEQ ID NO: 15, SEQ ID NO: 16, SEQ ID NO: 17, SEQ ID NO: 18, and SEQ ID NO: 19 is further modified to comprise a PEG chain is covalently linked to the side chain of an amino acid at position 17 or 21 of the glucagon peptide. In some embodiments the pegylated glucagon/GLP-1 receptor co-agonist further comprises the sequence of SEQ ID NO: 26, SEQ ID NO: 27 or SEQ ID NO: 29.

In another embodiment the glucagon peptide comprises the sequence of SEQ ID NO: 55 or SEQ ID NO: 56, further comprising a C-terminal extension of SEQ ID NO: 26, SEQ ID NO: 29 or SEQ ID NO: 65 linked to the C-terminal amino acid of SEQ ID NO: 55 or SEQ ID NO: 56, and optionally further comprising a PEG chain covalently linked to the side chain of an amino acids at position 17, 18, 21, 24 or 29 or the C-terminal amino acid of the peptide. In another embodiment the glucagon peptide comprises the sequence of SEQ ID NO: 55 or SEQ ID NO: 56, wherein a PEG chain is covalently linked to the side chain of an amino acids at position 21 or 24 of the glucagon peptide and the peptide further comprises a C-terminal extension of SEQ ID NO: 26, or SEQ ID NO: 29.

In another embodiment the glucagon peptide comprises the sequence of SEQ ID NO: 55, or SEQ ID NO: 33 or SEQ ID NO: 34, wherein an additional amino acid is added to the carboxy terminus of SEQ ID NO: 33 or SEQ ID NO: 34, and a PEG chain is covalently linked to the side chain of the added amino acid. In a further embodiment, the pegylated glucagon analog further comprises a C-terminal extension of SEQ ID NO: 26 or SEQ ID NO: 29 linked to the C-terminal amino acid of SEQ ID NO: 33 or SEQ ID NO: 34. In another embodiment the glucagon peptide comprises the sequence of SEQ ID NO: 19, wherein a PEG chain is covalently linked to the side chain of the amino acid at position 30 of the glucagon peptide and the peptide further comprises a C-terminal extension of SEQ ID NO: 26 or SEQ ID NO: 29 linked to the C-terminal amino acid of SEQ ID NO: 19.

The polyethylene glycol chain may be in the form of a straight chain or it may be branched. In accordance with some embodiments the polyethylene glycol chain has an average molecular weight selected from the range of about 500 to about 10,000 Daltons. In some embodiments the polyethylene glycol chain has an average molecular weight selected from the range of about 1,000 to about 5,000 Daltons. In an alternative embodiment the polyethylene glycol chain has an average molecular weight selected from the range of about 10,000 to about 20,000 Daltons. In accordance with some embodiments the pegylated glucagon peptide comprises two or more polyethylene glycol chains covalently bound to the glucagon peptide wherein the total molecular weight of the glucagon chains is about 1,000 to about 5,000 Daltons. In some embodiments the pegylated glucagon agonist comprises a peptide consisting of SEQ ID NO: 5 or a glucagon agonist analog of SEQ ID NO: 5, wherein a PEG chain is covalently linked to the amino acid residue at position 21 and at position 24, and wherein the combined molecular weight of the two PEG chains is about 1,000 to about 5,000 Daltons.

In certain exemplary embodiments, the glucagon peptide comprises the amino acid sequence of SEQ ID NO: 1 with up to ten amino acid modifications and comprises an amino acid at position 10 which is acylated or alkylated. In some embodiments, the amino acid at position 10 is acylated or alkylated with a C4 to C30 fatty acid. In certain aspects, the amino acid at position 10 comprises an acyl group or an alkyl group which is non-native to a naturally-occurring amino acid.

In certain embodiments, the glucagon peptide comprising an amino acid at position 10 which is acylated or alkylated comprises a stabilized alpha helix. Accordingly, in certain aspects, the glucagon peptide comprises an acyl or alkyl group as described herein and an intramolecular bridge, e.g., a covalent intramolecular bridge (e.g., a lactam bridge) between the side chains of an amino acid at position i and an amino acid at position i+4, wherein i is 12, 16, 20, or 24. Alternatively or additionally, the glucagon peptide comprises an acyl or alkyl group as described herein and one, two, three or more of positions 16, 20, 21 and/or 24 of the glucagon peptide are substituted with an α,α-disubstituted amino acid, e.g., AIB. In some instances, the non-native glucagon peptide comprises Glu at position 16 and Lys at position 20, wherein optionally a lactam bridge lnkes the Glu and the Lys, and, optionally, the glucagon peptide further comprises one or more modifications selected from the group consisting of: Gln at position 17, Ala at position 18, Glu at position 21, Ile at position 23, and Ala at position 24.

Also, in any of the embodiments, wherein the glucagon peptide comprises an amino acid at position 10 which is acylated or alkylated, the glucagon peptide can further comprise a C-terminal amide in lieu of the C-terminal alpha carboxylate.

In some embodiments, the glucagon peptide comprising an acyl or alkyl group as described herein further comprises an amino acid substitution at position 1, at position 2, or at positions 1 and 2, wherein the amino acid substitution(s) achieve DPP-IV protease resistance. For example, the His at position 1 may be substituted with an amino acid selected from the group consisting of: D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine. Alternatively or additionally, the Ser at position 2 may be substituted with an amino acid selected from the group consisting of: D-serine, alanine, D-alanine, valine, glycine, N-methyl serine, N-methyl alanine, and amino isobutyric acid. In some embodiments the amino acid at position 2 is not D-serine.

The glucagon peptide comprising the amino acid at position 10 which is acylated or alkylated as described herein can comprise any amino acid sequence which is substantially related to SEQ ID NO: 1. For instance, the glucagon peptide comprises SEQ ID NO: 1 with up to 10 amino acid modifications (e.g., 0, 1, 2, 3, 4, 5, 6, 7, 8, 9, 10 modifications). In certain embodiments, the amino acid sequence of the acylated or alkylated glucagon peptide is greater than 25% identical to SEQ ID NO: 1 (e.g., greater than 30%, 35%, 40%, 50%, 60%, 70% 75%, 80%, 85%, 90%, 95%, 96%, 97%, 98%, 99%, or nearly 100% identical to SEQ ID NO: 1). In certain specific embodiments, the glucagon peptide is one which comprises SEQ ID NOs: 55 with an amino acid at position 10 acylated or alkylated as described herein. The glucagon peptide can be any of SEQ ID NOs: 55, 55 with 1 or 2 amino acid modifications, 2-4, 9-18, 20, 23-25, 33, 40-44, 53, 56, 61, 62, 64, 66-514, and 534.

The acyl or alkyl group of these embodiments may be any acyl or alkyl group described herein. For example, the acyl group may be a C4 to C30 (e.g., C8 to C24) fatty acyl group and the alkyl group may be a C4 to C30 (e.g., C8 to C24) alkyl group.

The amino acid to which the acyl or alkyl group is attached may be any of the amino acids described herein, e.g., an amino acid of any of Formula I (e.g., Lys), Formula II, and Formula III.

In some embodiments, the acyl group or alkyl group is directly attached to the amino acid at position 10. In some embodiments, the acyl or alkyl group is attached to the amino acid at position 10 via a spacer, such as, for example, a spacer which is 3 to 10 atoms in length, e.g., an amino acid or dipeptide. Suitable spacers for purposes of attaching an acyl or alkyl group are described herein.

In accordance with some embodiments, the Class 3 glucagon related peptide may be an analog of any of the foregoing Class 3 glucagon related peptides as described herein, which analog exhibits agonist activity at the GIP receptor. The activity level of the analog at the glucagon receptor, the GLP-1 receptor, and the GIP receptor, the potency at each of these receptors, and the selectivity for each of these receptors may be in accordance with the teachings of Class 2 glucagon related peptides described herein. See, the teachings under the subsection of the Class 2 glucagon related peptide section entitled "Activity."

In some embodiments of the invention, an analog of a glucagon peptide, which analog exhibits agonist activity at the GIP receptor, is provided. The analog in certain embodiments comprises the amino acid sequence of SEQ ID NO: 1 with at least one amino acid modification (optionally, up to 15 amino acid modifications), and an extension of 1 to 21 amino acids C-terminal to the amino acid at position 29 of the analog.

In certain aspects, the analogs comprise at least one amino acid modification and up to amino acid modifications (e.g., 1, 2, 3, 4, 5, 6, 7, 8, 9, 10, 11, 12, 13, 14, 15 amino acid modifications, up to 10 amino acid modifications). In certain embodiments, the analogs comprise at least one amino acid modification at up to 10 amino acid modifications and additional conservative amino acid modifications. Conservative amino acid modifications are described herein.

In some aspects, at least one of the amino acid modifications confers a stabilized alpha helix structure in the C-terminal portion of the analog. Modifications which achieve a stabilized alpha helix structure are described herein. See, for example, the teachings under the section entitled Stabilization of the alpha helix/Intramolecular bridges. In some aspects, the analog comprises an intramolecular bridge (e.g., a covalent intramolecular bridge, a non-covalent intramolecular bridge) between the side chains of two amino acids of the analog. In certain aspects, an intramolecular bridge links the side chains of the amino acids at positions i and i+4, wherein i is 12, 13, 16, 17, 20, or 24. In other aspects, an intramolecular bridge connects the side chains of the amino acids at positions j and j+3, wherein j is 17, or at positions k and k+7" wherein k is any integer between 12 and 22. In certain embodiments, the intramolecular bridge is a covalent intramolecular bridge, e.g., a lactam bridge. In specific aspects, the lactam bridge connects the side chains of the amino acids at positions 16 and 20. In particular aspects, one of the amino acids at positions 16 and 20 is a positive-charged amino acid and the other is a negative-charged amino acid. For example, the analog can comprise a lactam bridge connecting the side chains of a Glu at position 16 and a Lys at position 20. In other aspects, the negative-charged amino acid and the positive-charged amino acid form a salt bridge. In this instance, the intramolecular bridge is a non-covalent intramolecular bridge.

In particular aspects, the amino acid modification which confers a stabilized alpha helix is an insertion or substitution of an amino acid of SEQ ID NO: 1 with an α,α-disubstituted amino acid. Suitable α,α-disubstituted amino acids for purposes of stabilizing the alpha helix are described herein and include, for example, AIB. In some aspects, one, two, three, or more of the amino acids at positions 16, 20, 21, and 24 of SEQ ID NO: 1 are substituted with an α,α-disubstituted amino acid, e.g., AIB. In particular embodiments, the amino acid at position 16 is AIB.

The analog which exhibits agonist activity at the GIP receptor can comprise additional modifications, such as any of those described herein. For instance, the amino acid modifications may increase or decrease activity at one or both of the GLP-1 receptor and glucagon receptor. The amino acid modifications may increase stability of the peptide, e.g., increase resistance to DPP-IV protease degradation, stabilize the bond between amino acids 15 and 16. The amino acid modifications may increase the solubility of the peptide and/or alter the time of action of the analog at any of the GIP, glucagon, and GLP-1 receptors. A combination of any of these types of modifications may be present in the analogs which exhibit agonist activity at the GIP receptor.

Accordingly, in some aspects, the analog comprises the amino acid sequence of SEQ ID NO: 1 with one or more of: Gln at position 17, Ala at position 18, Glu at position 21, Ile at position 23, and Ala or Cys at position 24, or conservative amino acid substitutions thereof. In some aspects, the analog comprises a C-terminal amide in place of the C-terminal alpha carboxylate. In certain embodiments, the analog comprises an amino acid substitution at position 1, position 2, or positions 1 and 2, which substitution(s) achieve DPP-IV protease resistance. Suitable amino acid substitutions are described herein. For example, DMIA at position 1 and/or d-Ser or AIB at position 2. In some embodiments, the amino acid at position 2 is not D-serine.

Additionally or alternatively, the analog may comprise one or a combination of: (a) Ser at position 2 substituted with Ala; (b) Gln at position 3 substituted with Glu or a glutamine analog; (c) Thr at position 7 substituted with a Ile; (d) Tyr at position 10 substituted with Trp or an amino acid comprising an acyl or alkyl group which is non-native to a naturally-occurring amino acid; (e) Lys at position 12 substituted with Ile; (f) Asp at position 15 substituted with Glu; (g) Ser at position 16 substituted with Glu; (h) Gln at position 20 substituted with Ser, Thr, Ala, AIB; (i) Gln at position 24 substituted with Ser, Thr, Ala, AIB; (j) Met at position 27 substituted with Leu or Nle; (k) Asn at position 29 substituted with a charged amino acid, optionally, Asp or Glu; and (l) Thr at position 29 substituted with Gly or a charged amino acid, optionally, Asp or Glu.

In certain aspects, the analog does not comprise an amino acid modification at position 1 which modification confers GIP agonist activity. In some aspects, the amino acid at position 1 is not a large, aromatic amino acid, e.g., Tyr. In some embodiments, the amino acid at position 1 is an amino acid comprising an imidazole ring, e.g., His, analogs of His. In certain embodiments, the analog is not any of the compounds disclosed in U.S. Patent Application No. 61/151,349. In certain aspects, the analog comprises the amino acid sequence of any of SEQ ID NOs: 657-669.

With regard to the analogs which exhibit agonist activity at the GIP receptor, the analog comprises an extension of 1-21 amino acids (e.g., 5-19, 7-15, 9-12 amino acids). The extension of the analog may comprise any amino acid sequence, provided that the extension is 1 to 21 amino acids. In some aspects, the extension is 7 to 15 amino acids and in other aspects, the extension is 9 to 12 amino acids. In some embodiments, the extension comprises (i) the amino acid sequence of SEQ ID NO: 26 or 674, (ii) an amino acid sequence which has high sequence identity (e.g., at least 80%, 85%, 90%, 95%, 98%, 99%) with the amino acid sequence of SEQ ID NO: 26 or 674, or (iii) the amino acid sequence of (i) or (ii) with one or more conservative amino acid modifications.

In some embodiments, at least one of the amino acids of the extension is acylated or alkylated. The amino acid comprising the acyl or alkyl group may be located at any position of extension of the analog. In certain embodiments, the acylated or alkylated amino acid of the extension is located at one of positions 37, 38, 39, 40, 41, or 42 (according to the numbering of SEQ ID NO: 1) of the analog. In certain embodiments, the acylated or alkylated amino acid is located at position 40 of the analog.

In exemplary embodiments, the acyl or alkyl group is an acyl or alkyl group which is non-native to a naturally-occurring amino acid. For example, the acyl or alkyl group may be a C4 to C30 (e.g., C12 to C18) fatty acyl group or C4 to C30 (e.g., C12 to C18) alkyl. The acyl or alkyl group may be any of those discussed herein.

In some embodiments, the acyl or alkyl group is attached directly to the amino acid, e.g., via the side chain of the amino acid. In other embodiments, the acyl or alkyl group is attached to the amino acid via a spacer (e.g., an amino acid, a dipeptide, a tripeptide, a hydrophilic bifunctional spacer, a hydrophobic bifunctional spacer). In certain aspects, the spacer is 3 to 10 atoms in length. In some embodiments, the amino acid spacer is not γ-Glu. In some embodiments, the dipeptide spacer is not γ-Glu-γ-Glu.

Also, in exemplary embodiments, the amino acid to which the acyl or alkyl group is attached may be any of those described herein, including, for example, an amino acid of Fomula I, II, or III. The amino acid which is acylated or alkylated may be a Lys, for example. Suitable amino acids comprising an acyl or alkyl group, as well as suitable acyl groups and alkyl groups, are described herein. See, for example, the teachings under the sections entitled Acylation and Alkylation.

In other embodiments, 1-6 amino acids (e.g., 1-2, 1-3, 1-4, 1-5 amino acids) of the extension are positive-charged amino acids, e.g., amino acids of Formula IV, such as, for example, Lys. As used herein, the term "positive-charged amino acid" refers to any amino acid, naturally-occurring or non-naturally occurring, comprising a positive charge on an atom of its side chain at a physiological pH. In certain aspects, the positive-charged amino acids are located at any of positions 37, 38, 39, 40, 41, 42, and 43. In specific embodiments, a positive-charged amino acid is located at position 40.

In other instances, the extension is acylated or alkylated as described herein and comprises 1-6 positive charged amino acids as described herein.

In yet other embodiments, the analogs which exhibit agonist activity at the GIP receptor comprises (i) SEQ ID NO: 1 with at least one amino acid modification, (ii) an extension of 1 to 21 amino acids (e.g., 5 to 18, 7 to 15, 9 to 12 amino acids) C-terminal to the amino acid at position 29 of the analog, and (iii) an amino acid comprising an acyl or alkyl group which is non-native to a naturally-occurring amino acid which is located outside of the C-terminal extension (e.g., at any of positions 1-29). In some embodiments, the analog comprises an acylated or alkylated amino acid at position 10. In particular aspects, the acyl or alkyl group is a C4 to C30 fatty acyl or C4 to C30 alkyl group. In some embodiments, the acyl or alkyl group is attached via a spacer, e.g., an amino acid, dipeptide, tripeptide, hydrophilic bifunctional spacer, hydrophobic bifunctional spacer). In certain aspects, the analog comprises an amino acid modification which stabilizes the alpha helix, such as a salt bridge between a Glu at position 16 and a Lys at position 20, or an alpha, alpha-disubstituted amino acid at any one, two, three, or more of positions 16, 20, 21, and 24. In specific aspects, the analog additionally comprises amino acid modifications which confer DPP-IV protease resistance, e.g., DMIA at position 1, AIB at position 2. Analogs comprising further amino acid modifications are contemplated herein.

In certain embodiments, the analogs having GIP receptor activity exhibit at least 0.1% (e.g., at least 0.5%, 1%, 2%, 5%, 10%, 15%, or 20%) activity of native GIP at the GIP receptor. In some embodiments, the analogs exhibit more than 20% (e.g., more than 50%, more than 75%, more than 100%, more than 200%, more than 300%, more than 500%) activity of native GIP at the GIP receptor. In some embodiments, the analog exhibits appreciable agonist activity at one or both of the GLP-1 and glucagon receptors. In some aspects, the selectivity for these receptors (GIP receptor and GLP-1 receptor and/or glucagon receptor) are within 1000-fold. For example, the selectivity for the GLP-1 receptor of the analogs having GIP receptor activity can be less than 500-fold, 100-fold, within 50-fold, within 25 fold, within 15 fold, within 10 fold) the selectivity for the GIP receptor and/or the glucagon receptor.

In particular aspects, the analog comprises the structures of any of SEQ ID NOs: 657-669.

In accordance with some embodiments, the Class 3 glucagon related peptide comprises the amino acid sequence of native glucagon (SEQ ID NO: 1) comprising the following modifications: AIB at position 2, Glu at position 3, Lys at position 10, Glu at position 16, Gln at position 17, Ala at position 18, Lys at position 20, Glu at position 21, Ile at position 23, Ala at position 24; wherein Lys at position 10 is acylated with a C14 or C16 fatty acid, and wherein the C-terminal carboxylate is replaced with an amide. In a specific embodiment, this Class 3 glucagon related peptide is attached via its N-terminal amino acid to the dipeptide D-Lys-Sarcosine.

In accordance with some embodiments, the Class 3 glucagon related peptide comprises, consists essentially of, or consists of an amino acid sequence of any of SEQ ID NOs: 70-514, 517-534, or 554, optionally with up to 1, 2, 3, 4, or 5 further modifications that retain GLP-1 agonist and/or glucagon agonist activity. In certain embodiments, the Class 3 glucagon related peptide comprises the amino acids of any of SEQ ID NOs: 562-684, and 1701-1776. In some embodiments, the Class 3 glucagon related peptide comprises the amino acid sequences of any of SEQ ID NOs: 1801-1908.

Class 4 Glucagon Related Peptides

In certain embodiments, a glucagon related peptide is a Class 4 glucagon related peptide (see, e.g., International (PCT) Patent Application No. PCT/US2008/080973, incorporated herein by reference in its entirety).

All biological sequences referenced in the following section (SEQ ID NOs: 1301-1371) correspond to SEQ ID NOs: 1-71 in International Patent Application No. PCT/US2008/080973.

Activity

In accordance with some embodiments, Class 4 glucagon related peptides are provided (hereafter referred to as "Class 4 peptides"). In certain aspects a Class 4 peptide is provided which has glucagon antagonist activity. A glucagon antagonists would be used in any setting where the suppression of glucagon agonism is desired. The most immediate and obvious use would be in the treatment of diabetes where glucagon antagonism has been demonstrated in pre-clinical models of hyperglycemia to yield a lowering of blood glucose. Glucagon antagonists can be further modified to improve the biophysical stability and/or aqueous solubility of the compounds while maintaining the antagonist activity of the parent compound. In certain aspects a Class 4 peptide is defined as a pure glucagon antagonist.

The term "glucagon antagonist" refers to a compound that counteracts glucagon activity or prevents glucagon function. For example, a glucagon antagonist exhibits at least 60% inhibition (e.g., at least 70% inhibition) and preferably, at least 80% inhibition, of the maximum response achieved by glucagon at the glucagon receptor. In some embodiments, the glucagon antagonist exhibits at least 90% inhibition of the maximum response achieved by glucagon at the glucagon receptor. In a specific embodiment, the glucagon antagonist exhibits 100% inhibition of the maximum response achieved by glucagon at the glucagon receptor. Additionally, a glucagon antagonist at a concentration of about 1 µM exhibits less than about 20% of the maximum agonist activity achieved by glucagon at the glucagon receptor. In some embodiments, the glucagon antagonist exhibits less than about 10% of the maximum agonist activity achieved by glucagon at the glucagon receptor. In a specific embodiment, the glucagon antagonist exhibits less than about 5% of the maximum agonist activity achieved by glucagon at the glucagon receptor. In yet another specific embodiment, the glucagon antagonist exhibits 0% of the maximum agonist activity achieved by glucagon at the glucagon receptor.

A "pure glucagon antagonist" is a glucagon antagonist that does not produce any detected stimulation of glucagon or GLP-1 receptor activity, as measured by cAMP production using a validated in vitro model assay (see, e.g., PCT/US2008/080973). For example, a pure glucagon antagonist exhibits less than about 5% (e.g., less than about 4%, less than about 3%, less than about 2%, less than about 1%, about 0%) of the maximum agonist activity achieved by glucagon at the glucagon receptor and exhibits less than about 5% (e.g., less than about 4%, less than about 3%, less than about 2%, less than about 1%, and about 0%) of the maximum agonist activity achieved by GLP-1 at the GLP-1 receptor.

Accordingly, in some aspects, there is provided Class 4 peptides that exhibit pure glucagon antagonist activity. In accordance with some embodiments the glucagon antagonist exhibits activity that reduces glucagon receptor glucagon-induced cAMP production by a maximum of at least 50% when the glucagon receptor is contacted simultaneously with 0.8 nM of glucagon and the glucagon antagonist, as measured by cAMP production in an in vitro assay. In some embodiments, the glucagon antagonist reduces glucagon receptor glucagon-induced cAMP production by a maximum amount of at least 80%.

Class 4 peptides are believed to be suitable for any use that has previously been described for glucagon antagonists. Accordingly, the Class 4 peptides described herein can be used to treat hyperglycemia, or treat other metabolic diseases that result from high blood levels of glucagon or high blood glucose levels. In accordance with some embodiments the patient to be treated using the Class 4 peptides disclosed herein is a domesticated animal, and in another embodiment the patient to be treated is a human. Studies suggest that lack of glucagon suppression in diabetic patients contributes to postprandial hyperglycemia in part via accelerated glycogenolysis. Analysis of blood glucose during an Oral Glucose Tolerance Test (OGTT), and in the presence or absence of somatostatin-induced glucagon suppression, has shown a significant increase in glucose in subjects with higher glucagon levels. Accordingly, the Class 4 peptides of the present invention can be used to treat hyperglycemia, and are expected to be useful for treating a variety of types of diabetes including diabetes mellitus type I, diabetes mellitus type II, or gestational diabetes, either insulin-dependent or non-insulin-dependent, and reducing complications of diabetes including nephropathy, retinopathy and vascular disease.

In some embodiments the terminal ten amino acids of Exendin-4 (i.e. the sequence of SEQ ID NO: 1319 (GPSSGAPPPS)) are linked to the carboxy terminus of a Class 4 peptide. These fusion proteins are anticipated to have pharmacological activity for suppressing appetite and inducing weight loss/weight maintenance. In accordance with some embodiments the Class 4 peptides disclosed herein can be further modified to include the amino acid sequence of SEQ ID NO: 1319 (GPSSGAPPPS) linked to amino acid 24 of the Class 4 peptide of SEQ ID NO: 1342 and administered to individuals to induce weight loss or assist in weight maintenance. More particularly, the Class 4 peptide comprises a sequence selected from the group consisting of SEQ ID NO: 1302, SEQ ID NO: 1303, SEQ ID NO: 1304 SEQ ID NO: 1305, SEQ ID NO: 1306, SEQ ID NO: 1307, SEQ ID NO: 1308, SEQ ID NO: 1336, SEQ ID NO: 1339, SEQ ID NO: 1340 SEQ ID NO: 1341, SEQ ID NO: 1342, SEQ ID NO: 1343 and SEQ ID NO: 1344 and further comprising the amino acid sequence of SEQ ID NO: 1319 (GPSSGAPPPS) linked to amino acid 24 of the Class 4 peptide is used to suppress appetite and inducing weight loss/weight maintenance. In some embodiments the administered Class 4 peptide comprises the sequence of SEQ ID NO: 1346 or SEQ ID NO: 1347.

Such methods for reducing appetite or promoting loss of body weight are expected to be useful in reducing body weight, preventing weight gain, or treating obesity of various causes, including drug-induced obesity, and reducing complications associated with obesity including vascular disease (coronary artery disease, stroke, peripheral vascular disease, ischemia reperfusion, etc.), hypertension, onset of diabetes type II, hyperlipidemia and musculoskeletal diseases.

The Class 4 peptides of the invention may be administered alone or in combination with other anti-diabetic or anti-obesity agents. Anti-diabetic agents known in the art or under investigation include insulin, sulfonylureas, such as tolbutamide (Orinase), acetohexamide (Dymelor), tolazamide (Tolinase), chlorpropamide (Diabinese), glipizide (Glucotrol), glyburide (Diabeta, Micronase, Glynase), glimepiride (Amaryl), or gliclazide (Diamicron); meglitinides, such as repaglinide (Prandin) or nateglinide (Starlix); biguanides such as metformin (Glucophage) or phenformin; thiazolidinediones such as rosiglitazone (Avandia), pioglitazone (Actos), or troglitazone (Rezulin), or other PPARy inhibitors; alpha glucosidase inhibitors that inhibit carbohydrate digestion, such as miglitol (Glyset), acarbose (Precose/Glucobay); exenatide (Byetta) or pramlintide; Dipeptidyl peptidase-4 (DPP-4) inhibitors such as vildagliptin or sitagliptin; SGLT (sodium-dependent glucose transporter 1) inhibitors; or FBPase (fructose 1,6-bisphosphatase) inhibitors.

Anti-obesity agents known in the art or under investigation include appetite suppressants, including phenethylamine type stimulants, phentermine (optionally with fenfluramine or dexfenfluramine), diethylpropion (Tenuate®), phendimetrazine (Prelu-2®, Bontril®), benzphetamine (Didrex®), sibutramine (Meridia®, Reductil®); rimonabant (Acomplia®), other cannabinoid receptor antagonists; oxyntomodulin; fluoxetine hydrochloride (Prozac); Qnexa (topiramate and phentermine), Excalia (bupropion and zonisamide) or Contrave (bupropion and naltrexone); or lipase inhibitors, similar to xenical (Orlistat) or Cetilistat (also known as ATL-962), or GT 389-255.

The Class 4 peptides of the present invention can also be administered to patients suffering from catabolic wasting. It is estimated that over half of cancer patients experience catabolic wasting which is characterized by unintended and progressive weight loss, weakness, and low body fat and muscle. The syndrome is equally common in AIDS patients and can also be present in bacterial and parasitic diseases, rheumatoid arthritis, and chronic diseases of the bowel, liver, lungs, and heart. It is usually associated with anorexia and can manifest as a condition in aging or as a result of physical trauma. Catabolic wasting is a symptom that diminishes the quality of life, worsens the underlying condition, and is a major cause of death. Applicants anticipate that the Class 4 peptides disclosed herein can be administered to patients to treat catabolic wasting.

Pharmaceutical compositions comprising the Class 4 peptides disclosed herein can be formulated and administered to patients to using standard pharmaceutically acceptable carriers and routes of administration known to those skilled in the art. Accordingly the present disclosure also encompasses pharmaceutical compositions comprising one or more of the Class 4 peptides disclosed herein in combination with a pharmaceutically acceptable carrier. The pharmaceutical compositions may comprise the Class 4 peptides as the sole pharmaceutically active component, or the Class 4 peptides can be combined with one or more additional active agents. In accordance with some embodiments a composition is provided comprising a Class 4 peptide of the present invention and a compound that activates the GLP-1 receptor (such as GLP-1, a GLP-1 analog, an exendin-4 analog, or derivatives thereof). In accordance with some embodiments a composition is provided comprising a Class 4 peptide of the present invention and insulin or an insulin analog. Alternatively, a composition provided for inducing weight loss or preventing weight gain can be provided that comprises the sequence of SEQ ID NO: 1342 further comprising the amino acid sequence of SEQ ID NO: 1319 (GPSSGAPPPS) linked to amino acid 24 of SEQ ID NO: 1342, and an anti-obesity peptide. Suitable anti-obesity peptides include those disclosed in U.S. Pat. Nos. 5,691,309, 6,436,435 or US Patent application 20050176643, and including, but not limited to GLP-1, GIP (Gastric Inhibitory Polypeptide), MP1, PYY, MC-4, Leptin.

Class 4 Peptide Structure

In some embodiments Class 4 glucagon related peptides are provided wherein the normally occurring aspartic acid at position nine (of glucagon, SEQ ID NO: 1301) has been substituted with glutamic acid or a cysteic acid-based derivative. More particularly, deletion of the first amino acid (des-His) and substitution of the aspartic acid at position 9 with glutamic acid, in some aspects, produces a Class 4 peptide. Class 4 glucagon related peptides having sulfonic acid substituents substituted at amino acid position nine of glucagon perform similarly to the carboxylic acid-based amino acids but with a few critical differences in relation to physical properties such as solubility. Homocysteic acid (hCysSO$_3$) when substituted for the isosteric glutamic acid at position nine in the conventional des-His, Glu9 Class 4 peptide retains a partial antagonist and weak agonist.

In some embodiments there is provided a Class 4 peptide wherein the first two to five amino acids are removed, and position 9 (according to the numbering of SEQ ID NO: 1301) is replaced with hCys(SO$_3$), homoglutamic acid, β-homoglutamic acid, or an alkylcarboxylate derivative of cysteine having the structure of:

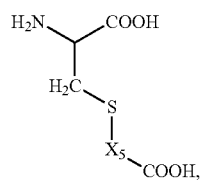

wherein X$_5$ is C$_1$-C$_4$ alkyl, C$_2$-C$_4$ alkenyl, or C$_2$-C$_4$ alkynyl, provides a compound that performs as a hormonal antagonist that is highly specific, potent and without contaminating agonist properties.

In accordance with some embodiments a Class 4 peptide is provided that comprises a glucagon peptide modified, relative to the wild type sequence of SEQ ID NO: 1301, by the deletion of two to five amino acid residues from the N-terminus and substitution of the aspartic acid residue at position nine of the native protein with a glutamic acid, homoglutamic acid, β-homoglutamic acid, a sulfonic acid derivative of cysteine, or an alkylcarboxylate derivative of cysteine having the structure of:

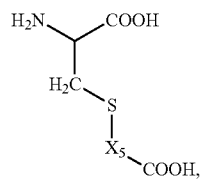

wherein X$_5$ is C$_1$-C$_4$ alkyl, C$_2$-C$_4$ alkenyl, or C$_2$-C$_4$ alkynyl.

In one specific embodiment, the Class 4 peptide comprising the deletion of two to five amino acid residues from the N-terminus and substitution of the Asp at position 9 of the native glucagon, is further modified by up to three amino acid modifications. For example, the Class 4 peptide may comprise one, two, or three conservative amino acid modifications. Alternatively or additionally, the Class 4 peptide may comprise one or more amino acid modifications selected from the group consisting of:

A. substitution of one or two amino acids at positions 10, 20, and 24, (according to the amino acid numbering of SEQ ID NO: 1301), or the N- or C-terminal amino acid of the Class 4 peptide with an amino acid covalently attached to an acyl group or alkyl group via an ester, ether, thioether, amide, or alkyl amine linkage;

B. substitution of one or two amino acids at positions 16, 17, 20, 21, and 24 (according to the amino acid numbering of SEQ ID NO: 1301), or the N- or C-terminal amino acid of the Class 4 peptide with an amino acid selected from the group consisting of: Cys, Lys, ornithine, homocysteine, and acetyl-phenylalanine (Ac-Phe), wherein the amino acid of the group is covalently bonded to a hydrophilic moiety;

C. addition of an amino acid covalently bonded to a hydrophilic moiety to the N- or C-terminus of the Class 4 peptide;

D. substitution of Asp at position 15 (according to the numbering of SEQ ID NO: 1301) with cysteic acid, glutamic acid, homoglutamic acid, and homocysteic acid;

E. substitution of Ser at position 16 (according to the numbering of SEQ ID NO: 1301) with cysteic acid, glutamic acid, homoglutamic acid, and homocysteic acid;

F. substitution with AIB at one or more of positions 16, 20, 21, and 24 according to the amino acid numbering of SEQ ID NO: 1301;

G. deletion of the amino acid at position 29 or the amino acids at positions 28 and 29, according to the numbering of SEQ ID NO: 1301;

H. substitution of each or both of the Asn at position 28 and the Thr at position 29 (according to the amino acid numbering of SEQ ID NO: 1301) with charged amino acids; and/or addition of one to two charged amino acids at the C-terminus of SEQ ID NO: 1301;

I. substitution of the Met at position 27 (according to the numbering of SEQ ID NO: 1301) with Leu or norleucine;

J. addition of a peptide having the amino acid sequence of any of SEQ ID NOs: 19-21 and 53 to the C-terminus of SEQ ID NO: 1301; wherein Thr at position 29 (according to the numbering of SEQ ID NO: 1301) is Thr or Gly; and K. replacement of the C-terminal carboxylate with an amide or ester.

In a specific embodiment, the Class 4 peptide comprises an amino acid modification of A, B, or C, as described above, or a combination thereof. In yet another specific embodiment, the Class 4 peptide further comprises an amino acid modification of any of D to K as described above, or a combination thereof, in addition to the amino acid modification(s) of A, B, and/or C.

In some embodiments the Class 4 peptide comprises a glucagon peptide, wherein the first 5 amino acids have been removed from the N-terminus, and the remaining N-terminal amino group has been replaced with a hydroxyl group (the "PLA6 analog"), producing the peptide of SEQ ID NO: 1339. Applicants have found that substitution of phenyl-lactic acid for phenylalanine in Class 4 peptide analogs that have the first five amino acids deleted and substitution of a glutamic acid at position 9 (relative to native glucagon) further enhances the potency of those Class 4 peptide analogs.

In some embodiments the Class 4 peptide peptide of SEQ ID NO: 1339 is further modified by substituting the aspartic acid residue at position four (position 9 of the native glucagon) with an amino acid of the general structure:

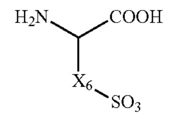

wherein $X_6$ is $C_1$-$C_3$ alkyl, $C_2$-$C_3$ alkene or $C_2$-$C_3$ alkynyl, and in some embodiments $X_6$ is $C_1$-$C_3$ alkyl, and in another embodiment $X_6$ is $C_2$ alkyl. In some embodiments the Class 4 peptide comprises a glucagon peptide, wherein the first 5 amino acids have been removed from the N-terminus, and the aspartic acid residue at position four (position 9 of the native glucagon) has been substituted with cysteic acid or homocysteic acid. In some embodiments the Class 4 peptide comprises a glucagon peptide comprising an amino acid sequence selected from the group consisting of SEQ ID NO: 1339, SEQ ID NO: 1307 and SEQ ID NO: 1308. In some embodiments the Class 4 peptide comprises an amino acid sequence selected from the group consisting of SEQ ID NO: 1308, wherein the amino acid at position four is homocysteic acid.

In another embodiment, the Class 4 peptide of SEQ ID NO: 1339 is further modified by substituting the aspartic acid residue at position four (position 9 of the native glucagon) with glutamic acid, homoglutamic acid, β-homoglutamic acid, or an alkylcarboxylate derivative of cysteine having the structure of:

wherein $X_5$ is $C_1$-$C_4$ alkyl, $C_2$-$C_4$ alkenyl, or $C_2$-$C_4$ alkynyl. In a specific embodiment, $X_5$ is $C_1$ or $C_2$ alkyl.

However, applicants have discovered that with the substitution of the N-terminal phenylalanine with PLA in a desl-5 glucagon analog (i.e., a glucagon analog having the first five amino acids deleted), further substitution of the native aspartic acid residue at position four (position 9 of the native glucagon) is not required to produce an analog that exhibits pure antagonism. This result is surprising in light of the prior art teachings that the native aspartic acid residue at position four must substituted to produce high affinity and potent antagonists of glucagon (2-29) analogs. The use of the PLA substitution improves the relative potency of the Asp9 analog to a point comparable to that of the Glu9 and $hCys(SO_3H)9$ analogs.

Substitution of the phenylalanine residue with other phenylalanine analogs, including 3,4-2F-phenylalnine (3,4-2F-Phe), 2-naphthyalanine (2-Nal), N-acyl-phenylalanine (Ac-Phe), alpha-methylhydrocinnamic acid (MCA) and benzylmalonic acid (BMA) did not perform as potently as the PLA substitution.

Substituting PLA at sites other than at position six (according to the amino acid numbering of native glucagon), including at positions 4 and 5 reveals that the PLA6 analog is an appreciably more potent antagonist than glucagon analogs having a slightly extended N-terminus. The present invention also includes analogs wherein the N-terminal amino group is substituted with an acylated and alkylated "O-terminal" peptides.

Furthermore, the PLA6 substitution not only increases the potency of the antagonist but also serves a critical role in pegylation. The PLA6 analogs can be selectively pegylated without restoration of glucagon agonism. In the absence of the PLA substitution, pegylation of the analog surprisingly induces glucagon agonism. This glucagon agonism is not seen in the pegylated PLA6 analogs. Several sites for pegylation were investigated including positions 3, 6 and 19 (positions 8, 11 and 19 of native glucagon) and at the N-terminal amino acid residue. In some embodiments the pegylation is at position 19 (position 24 of native glucagon) as that site exhibits the most potent and selective glucagon antagonism.

In some embodiments, the Class 4 peptide comprises the general structure of A-B-C, wherein A is selected from the group consisting of:

(i) phenyl lactic acid (PLA);

(ii) an oxy derivative of PLA;

(iii) a peptide of 2 to 6 amino acids in which two consecutive amino acids of the peptide are linked via an ester or ether bond;

B represents amino acids i to 26 of SEQ ID NO: 1301, wherein i is 3, 4, 5, 6, or 7, optionally comprising one or more amino acid modifications selected from the group consisting of:

(iv) Asp at position 9 (according to the amino acid numbering of SEQ ID NO: 1301) is substituted with a Glu, a sulfonic acid derivative of Cys, homoglutamic acid, β3-homoglutamic acid, or an alkylcarboxylate derivative of cysteine having the structure of:

$$H_2N\diagdown\diagup COOH$$
$$H_2C\diagdown S$$
$$X_5\diagdown COOH,$$

wherein $X_5$ is $C_1$-$C_4$ alkyl, $C_2$-$C_4$ alkenyl, or $C_2$-$C_4$ alkynyl.

(v) substitution of one or two amino acids at positions 10, 20, and 24, (according to the amino acid numbering of SEQ ID NO: 1301) with an amino acid covalently attached to an acyl or alkyl group via an ester, ether, thioether, amide, or alkyl amine linkage;

(vi) substitution of one or two amino acids at positions 16, 17, 20, 21, and 24 (according to the amino acid numbering of SEQ ID NO: 1301) with an amino acid selected from the group consisting of: Cys, Lys, ornithine, homocysteine, and acetyl-phenylalanine (Ac-Phe), wherein the amino acid of the group is covalently attached to a hydrophilic moiety;

(vii) Asp at position 15 (according to the numbering of SEQ ID NO: 1301) is substituted with cysteic acid, glutamic acid, homoglutamic acid, and homocysteic acid;

(viii) Ser at position 16 (according to the numbering of SEQ ID NO: 1301) is substituted with cysteic acid, glutamic acid, homoglutamic acid, and homocysteic acid;

(ix) substitution with AIB at one or more of positions 16, 20, 21, and 24 according to the amino acid numbering of SEQ ID NO: 1301;

and C is selected from the group consisting of:

(x) X;

(xi) X—Y;

(xii) X—Y—Z; and (xiii) X—Y—Z—R10, wherein X is Met, Leu, or Nle; Y is Asn or a charged amino acid; Z is Thr, Gly, Cys, Lys, ornithine (Orn), homocysteine, acetyl phenylalanine (Ac-Phe), or a charged amino acid; wherein R10 is selected from a group consisting of SEQ ID NOs: 1319-1321 and 1353; and (xiv) any of (x) to (xiii) in which the C-terminal carboxylate is replaced with an amide.

In a specific aspect, the Class 4 peptide comprises an oxy derivative of PLA. As used herein "oxy derivative of PLA" refers to a compound comprising a modified structure of PLA in which the hydroxyl group has been replaced with O—$R_{11}$, wherein $R_{11}$ is a chemical moiety. In this regard, the oxy derivative of PLA can be, for example, an ester of PLA or an ether of PLA.

Methods of making oxy derivatives of PLA are known in the art. For example, when the oxy derivative is an ester of PLA, the ester may be formed by upon reaction of the hydroxyl of PLA with a carbonyl bearing a nucleophile. The nucleophile can be any suitable nucleophile, including, but not limited to an amine or hydroxyl. Accordingly, the ester of PLA can comprise the structure of Formula IV:

Formula IV wherein R7 is an ester formed upon reaction of the hydroxyl of PLA with a carbonyl bearing a nucleophile.

The carbonyl bearing a nucleophile (which reacts with the hydroxyl of PLA to form an ester) can be, for example, a carboxylic acid, a carboxylic acid derivative, or an activated ester of a carboxylic acid. The carboxylic acid derivative can be, but is not limited to, an acyl chloride, an acid anhydride, an amide, an ester, or a nitrile. The activated ester of a carboxylic acid can be, for example, N-hydroxysuccinimide (NHS), tosylate (Tos), a carbodiimide, or a hexafluorophosphate. In some embodiments, the carbodiimide is 1,3-dicyclohexylcarbodiimide (DCC), 1,1'-carbonyldiimidazole (CDI), 1-ethyl-3-(3-dimethylaminopropyl)carbodiimide hydrochloride (EDC), or 1,3-diisopropylcarbodiimide (DICD). In some embodiments, the hexafluorophosphate is selected from a group consisting of hexafluorophosphate benzotriazol-1-yl-oxy-tris(dimethylamino)phosphonium hexafluorophosphate (BOP), benzotriazol-1-yl-oxytripyrrolidinophosphonium hexafluorophosphate (PyBOP), 2-(1H-7-azabenzotriazol-1-yl)-1,1,3,3-tetramethyl uronium hexafluorophosphate (HATU), and o-benzotriazole-N,N,N',N'-tetramethyl-uronium-hexafluoro-phosphate (HBTU).

Methods of making ethers from reaction with a hydroxyl group (e.g., the hydroxyl of PLA) also are known in the art.

For example, the hydroxyl group of PLA may be reacted with a halogenated alkyl or tosylated alkyl alcohol to form an ether bond.

Generally, the chemical moiety of $R_{11}$ is one which does not decrease the activity of the Class 4 peptide. In some embodiments, the chemical moiety enhances the activity, stability, and/or solubility of the Class 4 peptide.

In a specific embodiment, the chemical moiety bound to PLA via an oxygen-containing bond (e.g., via an ester or ether bond) is a polymer (e.g., a polyalkylene glycol), a carbohydrate, an amino acid, a peptide, or a lipid, e.g., a fatty acid or a steroid.

In a specific embodiment, the chemical moiety is an amino acid, which, optionally, is a part of a peptide, such that Formula IV is a depsipeptide. In this regard, PLA may be at a position other than the N-terminal amino acid residue of the Class 4 peptide, such that the Class 4 peptide comprises one or more (e.g., 1, 2, 3, 4, 5, 6, or more) amino acids N-terminal to the PLA residue. For example, the Class 4 peptide can comprise PLA at position n, wherein n is 2, 3, 4, 5, or 6 of the Class 4 peptide.

The amino acids N-terminal to the PLA residue may be synthetic or naturally-occurring. In a specific embodiment, the amino acids which are N-terminal PLA are naturally-occurring amino acids. In some embodiments, the amino acids which are N-terminal to PLA are the N-terminal amino acids of native glucagon. For example, the Class 4 peptide can comprise at the N-terminus the amino acid sequence of any of SEQ ID NOs: 1354-1358, wherein PLA is linked to threonine via an ester bond:

```
His-Ser-Gln-Gly-Thr-PLA      SEQ ID NO: 1354

Ser-Gln-Gly-Thr-PLA          SEQ ID NO: 1355

Gln-Gly-Thr-PLA              SEQ ID NO: 1356

Gly-Thr-PLA                  SEQ ID NO: 1357

Thr-PLA                      SEQ ID NO: 1358
```

In an alternative embodiment, one or more of the N-terminal amino acids may be substituted with an amino acid other than the amino acid of native glucagon. For example, when the Class 4 peptide comprises PLA as the amino acid at position 5 or 6, the amino acid at position 1 and/or position 2 may be an amino acid which reduces susceptibility to cleavage by dipeptidyl peptidase IV. More particularly, in some embodiments, position 1 of the Class 4 peptide is an amino acid selected from the group consisting of D-histidine, alpha, alpha-dimethyl imidiazole acetic acid (DMIA), N-methyl histidine, alpha-methyl histidine, imidazole acetic acid, desamino-histidine, hydroxyl-histidine, acetyl-histidine and homo-histidine. More particularly, in some embodiments, position 2 of the antagonist peptide is an amino acid selected from the group consisting of D-serine, D-alanine, valine, glycine, N-methyl serine, N-methyl alanine, and aminoisobutyric acid (AIB). Also, for example, when the Class 4 peptide comprises PLA as the amino acid at position 4, 5, or 6, the amino acid at position 3 of the Class 4 peptide may be glutamic acid, as opposed to the native glutamine residue of native glucagon. In an exemplary embodiment of the invention, the Class 4 peptide comprises at the N-terminus the amino acid sequence of any of SEQ ID NOs: 1359-1361.

With respect to the Class 4 peptides comprising a compound of Formula IV, the polymer may be any polymer, provided that it can react with the hydroxyl group of PLA. The polymer may be one that naturally or normally comprises a carbonyl bearing a nucleophile. Alternatively, the polymer may be one which was derivatized to comprise the carbonyl bearing the carbonyl. The polymer may be a derivatized polymer of any of: polyamides, polycarbonates, polyalkylenes and derivatives thereof including, polyalkylene glycols, polyalkylene oxides, polyalkylene terepthalates, polymers of acrylic and methacrylic esters, including poly(methyl methacrylate), poly(ethyl methacrylate), poly(butylmethacrylate), poly(isobutyl methacrylate), poly(hexylmethacrylate), poly (isodecyl methacrylate), poly(lauryl methacrylate), poly (phenyl methacrylate), poly(methyl acrylate), poly(isopropyl acrylate), poly(isobutyl acrylate), and poly(octadecyl acrylate), polyvinyl polymers including polyvinyl alcohols, polyvinyl ethers, polyvinyl esters, polyvinyl halides, poly(vinyl acetate), and polyvinylpyrrolidone, polyglycolides, polysiloxanes, polyurethanes and co-polymers thereof, celluloses including alkyl cellulose, hydroxyalkyl celluloses, cellulose ethers, cellulose esters, nitro celluloses, methyl cellulose, ethyl cellulose, hydroxypropyl cellulose, hydroxy-propyl methyl cellulose, hydroxybutyl methyl cellulose, cellulose acetate, cellulose propionate, cellulose acetate butyrate, cellulose acetate phthalate, carboxylethyl cellulose, cellulose triacetate, and cellulose sulphate sodium salt, polypropylene, polyethylenes including poly(ethylene glycol), poly(ethylene oxide), and poly(ethylene terephthalate), and polystyrene.

The polymer can be a biodegradable polymer, including a synthetic biodegradable polymer (e.g., polymers of lactic acid and glycolic acid, polyanhydrides, poly(ortho)esters, polyurethanes, poly(butic acid), poly(valeric acid), and poly (lactide-cocaprolactone)), and a natural biodegradable polymer (e.g., alginate and other polysaccharides including dextran and cellulose, collagen, chemical derivatives thereof (substitutions, additions of chemical groups, for example, alkyl, alkylene, hydroxylations, oxidations, and other modifications routinely made by those skilled in the art), albumin and other hydrophilic proteins (e.g., zein and other prolamines and hydrophobic proteins)), as well as any copolymer or mixture thereof. In general, these materials degrade either by enzymatic hydrolysis or exposure to water in vivo, by surface or bulk erosion.

The polymer can be a bioadhesive polymer, such as a bioerodible hydrogel described by H. S. Sawhney, C. P. Pathak and J. A. Hubbell in Macromolecules, 1993, 26, 581-587, the teachings of which are incorporated herein, polyhyaluronic acids, casein, gelatin, glutin, polyanhydrides, polyacrylic acid, alginate, chitosan, poly(methyl methacrylates), poly(ethyl methacrylates), poly(butylmethacrylate), poly (isobutyl methacrylate), poly(hexylmethacrylate), poly(isodecyl methacrylate), poly(lauryl methacrylate), poly(phenyl methacrylate), poly(methyl acrylate), poly(isopropyl acrylate), poly(isobutyl acrylate), and poly(octadecyl acrylate).

In some embodiments, the polymer is a water-soluble polymer. Suitable water-soluble polymers are known in the art and include, for example, polyvinylpyrrolidone, hydroxypropyl cellulose (HPC; Klucel), hydroxypropyl methylcellulose (HPMC; Methocel), nitrocellulose, hydroxypropyl ethylcellulose, hydroxypropyl butylcellulose, hydroxypropyl pentylcellulose, methyl cellulose, ethylcellulose (Ethocel), hydroxyethyl cellulose, various alkyl celluloses and hydroxyalkyl celluloses, various cellulose ethers, cellulose acetate, carboxymethyl cellulose, sodium carboxymethyl cellulose, calcium carboxymethyl cellulose, vinyl acetate/crotonic acid copolymers, poly-hydroxyalkyl methacrylate, hydroxymethyl methacrylate, methacrylic acid copolymers, polymethacrylic acid, polymethylmethacrylate, maleic anhydride/methyl vinyl ether copolymers, poly vinyl alcohol, sodium and calcium polyacrylic acid, polyacrylic acid, acidic carboxy polymers, carboxypolymethylene, carboxyvinyl polymers, polyoxyethylene polyoxypropylene copolymer, polymethylvinylether co-maleic anhydride, carboxymethylamide, potassium methacrylate divinylbenzene co-polymer, polyoxyethyleneglycols, polyethylene oxide, and derivatives, salts, and combinations thereof.

In a specific embodiment, the polymer is a polyalkylene glycol, including, for example, polyethylene glycol (PEG).

The carbohydrate may be any carbohydrate provided that it comprises or is made to comprise a carbonyl with an alpha leaving group. The carbohydrate, for example, may be one which has been derivatized to comprise a carbonyl with an alpha leaving group. In this regard, the carbohydrate may be a derivatized form of a monosaccharide (e.g., glucose, galactose, fructose), a disaccharide (e.g., sucrose, lactose, maltose), an oligosaccharide (e.g., raffinose, stachyose), a polysaccharide (a starch, amylase, amylopectin, cellulose, chitin, callose, laminarin, xylan, mannan, fucoidan, galactomannan.

With respect to the Class 4 peptides comprising a compound of Formula IV, the lipid may be any lipid comprising a carbonyl with an alpha leaving group. The lipid, for example, may be one which is derivatized to comprise the carbonyl. In this regard, the lipid, may be a derivative of a fatty acid (e.g., a $C_4$-$C_{30}$ fatty acid, eicosanoid, prostaglandin, leukotriene, thromboxane, N-acyl ethanolamine), glycerolipid (e.g., mono-, di-, tri-substituted glycerols), glycerophospholipid (e.g., phosphatidylcholine, phosphatidylinositol, phosphatidylethanolamine, phosphatidylserine), sphingolipid (e.g., sphingosine, ceramide), sterol lipid (e.g., steroid, cholesterol), prenol lipid, saccharolipid, or a polyketide. oil, wax, cholesterol, sterol, fat-soluble vitamin, monoglyceride, diglyceride, triglyceride, a phospholipid.

In some embodiments, R7 has a molecular weight of about 100 kDa or less, e.g., about 90 kDa or less, about 80 kDa or less, about 70 kDa or less, about 60 kDa or less, about 50 kDa or less, about 40 kDa or less. Accordingly, R7 can have a molecular weight of about 35 kDa or less, about 30 kDa or less, about 25 kDa or less, about 20 kDa or less, about 15 kDa or less, about 10 kDa or less, about 5 kDa or less, or about 1 kDa.

In an alternative embodiment, the Class 4 peptide comprises as A, a peptide of 2 to 6 amino acids in which two consecutive amino acids of the peptide are linked via an ester or ether bond. The ester or ether bond may be, e.g., between amino acids 2 and 3, 3 and 4, 4 and 5, or 5 and 6. Optionally the peptide may be further modified by covalent linkage to another chemical moiety including linkage to a polymer (e.g. a hydrophilic polymer), alkylation, or acylation.

With regard to the Class 4 peptide comprising the general structure A-B-C, B represents amino acids of native glucagon, e.g., i to 26 of SEQ ID NO: 1301, wherein i is 3, 4, 5, 6, or 7, optionally comprising one or more amino acid modifications. In a specific embodiment, B represents amino acids 7 to 26 of SEQ ID NO: 1301, optionally further modified.

In some embodiments, B is modified by up to three amino acid modifications. For example, B, which represents native amino acid sequence of SEQ ID NO: 1301 is modified by one or more conservative amino acid modifications.

In another embodiment, B comprises one or more amino acid modifications selected from the group consisting of (iv) to (ix), as described herein. In a specific embodiment, B comprises one or both of the amino acid modifications (v) and (vi). In a further specific embodiment, B comprises one or a combination of amino acid modifications selected from the group consisting of (iv), (vii), (viii), and (ix), in addition to (v) and (vi).

In another specific embodiment, the Class 4 peptide comprises one or more charged amino acids at the C-terminus. For example, Y and/or Z can be a charged amino acid, e.g., Lys, Arg, His, Asp, and Glu. In yet another embodiment, the Class 4 peptide comprises one to two charged amino acids (e.g., Lys, Arg, His, Asp, and Glu) C-terminal to Z. In a specific aspect, Z followed by one to two charged amino acids does not comprise R10.

The Class 4 peptide in some embodiments comprises a hydrophilic moiety covalently bound to an amino acid residue of the Class 4 peptide, as described herein. For example, the Class 4 peptide can comprise a hydrophilic moiety covalently attached to an amino acid at position 1, 16, 20, 21, or 24 according to the numbering of SEQ ID NO: 1301. In another embodiment, the hydrophilic moiety is attached to the C-terminal amino acid of the Class 4 peptide, which in some cases, is 1 or 11 amino acids C-terminal to Z. In yet another embodiment, the hydrophilic moiety is attached to PLA, when A is PLA, PLA-Phe, or PLA-Thr-Phe, wherein PLA is modified to comprise the hydrophilic moiety. In another embodiment, an amino acid comprising a hydrophilic moiety is added to the N- or C-terminus of the Class 4 peptide. In another embodiment, the Class 4 peptide comprises an acyl group or alkyl group as described herein. For example, the acylation or alkylation can occur off the side chain of the amino acid at position 10, 20, or 24, according to the numbering of SEQ ID NO: 1301. In an alternative embodiment, the acylation or alkylation occurs off the side chain of the C-terminal amino acid of the Class 4 peptide, which in some cases, is 1 or 11 amino acids C-terminal to Z. In yet another embodiment, when A is PLA, PLA-Phe, or PLA-Thr-Phe, the PLA is modified to comprise an acyl or alkyl group.

Exemplary Embodiments

The Class 4 peptide may comprise any amino acids, synthetic or naturally occurring, provided that at least two consecutive amino acids of the peptide are linked via an ester or ether bond. In a specific embodiment, the peptide comprises amino acids of native glucagon. For example, the peptide can comprise j to 6 of native glucagon (SEQ ID NO: 1301), wherein j is 1, 2, 3, 4, or 5. Alternatively, the peptide can comprise an amino acid sequence based on the N-terminus of SEQ ID NO: 1301 with one or more amino acid modifications. The amino acid at position 1 and/or position 2 may be an amino acid which reduces susceptibility to cleavage by dipeptidyl peptidase IV. For instance, the peptide can comprise at position 1 of the Class 4 peptide an amino acid selected from the group consisting of D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine. More particularly, in some embodiments, position 2 of the antagonist peptide is an amino acid selected from the group consisting of D-serine, D-alanine, valine, glycine, N-methyl serine, N-methyl alanine, and aminoisobutyric acid (AIB). Also, for example, the amino acid at position 3 of the Class 4 peptide may be glutamic acid, as opposed to the native glutamine residue of native glucagon. Accordingly, the Class 4 peptide can comprise an amino acid sequence of:

```
Xaa₁-Xaa₂-Xaa₃-Thr-Gly-Phe;     (SEQ ID NO: 1368)

Xaa₂-Xaa₃-Thr-Gly-Phe;          (SEQ ID NO: 1369)
or

Xaa₃-Thr-Gly-Phe;               (SEQ ID NO: 1370)
``` wherein Xaa₁ is selected from a group consisting of: His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine; Xaa₂ is selected from a group consisting of: Ser, D-serine, D-alanine, valine, glycine, N-methyl serine, N-methyl alanine, and aminoisobutyric acid (AIB); and Xaa₃ is Gln or Glu.

The present invention also encompasses embodiments wherein the C-terminal amino acid of the Class 4 peptides have an amide group substituting for the carboxylic acid group that is present on the native amino acid.

In some embodiments, wherein the Class 4 peptide is PEGylated, the Class 4 peptide comprises the shortened glucagon peptides, specifically 6-29 where the "N-terminal" amino acid is PLA (phenyl-lactic acid). Such glucagon derivatives exhibit unique virtues. They are more potent peptides than those with the native N-terminal phenylalanine and they suppress any glucagon agonism that results from pegylation, something not seen with the native phenylalanine. Finally, while the current literature establishes that a substitution of the native aspartic acid at position 9 is required for antagonist activity, applicants have discovered the surprising result that such a substitution is no longer required in the PLA⁶-(6-29) glucagon analogs.

In some embodiments an amino acid of the Class 4 peptide is substituted with at least one cysteine residue, wherein the side chain of the cysteine residue is further modified with a thiol reactive reagent, including for example, maleimido, vinyl sulfone, 2-pyridylthio, haloalkyl, and haloacyl. These thiol reactive reagents may contain carboxy, keto, hydroxyl, and ether groups as well as other hydrophilic moieties such as polyethylene glycol units. In an alternative embodiment, an amino acid of the Class 4 peptide is substituted with lysine, and the side chain of the substituting lysine residue is further modified using amine reactive reagents such as active esters (succinimido, anhydride, etc) of carboxylic acids or aldehydes of hydrophilic moieties such as polyethylene glycol. In accordance with some embodiments the lysine residue corresponding to position 12 of the native peptide is substituted with arginine and a single lysine substitution is inserted for one of the amino acids corresponding to position 1, 16, 17, 20, 21, 24 or 29 of the native peptide, or a lysine is added to the N- or C-terminus of the Class 4 peptide.

In another embodiment the methionine residue corresponding to position 27 of the native peptide is changed to leucine or norleucine to prevent oxidative degradation of the peptide.

In some embodiments, the Class 4 peptides described herein are further modified by truncation or deletion of one or two amino acids of the C-terminus of the glucagon peptide (i.e., truncation of the amino acid at position 29 or at positions 28 and 29 of native glucagon) without affecting activity and/or potency at the glucagon receptor. In this regard, the Class 4 peptide described herein can, for example, consist essentially of or consist of amino acids 1-27, 1-28, 2-27, 2-28, 3-27, 3-28, 4-27, 4-28, 5-27, 5-28, 6-27, or 6-28 of the native glucagon peptide (SEQ ID NO: 1301) with one or more modifications resulting in Class 4 peptideic activity as described herein.

The presently disclosed Class 4 peptides also encompass amino acid substitutions at positions that are known not to be critical to the function of the glucagon peptide. In some embodiments the substitutions are conservative amino acid substitutions at one, two or three positions selected from the group consisting of 2, 5, 6, 7, 8, 9, 12, 13, 14, 15, 16, 19, 22, 23 or 24 of SEQ ID NO: 1339. In some embodiments the Class 4 peptide comprises a derivative peptide of SEQ ID NO: 1342 wherein the glucagon peptide comprises a further amino acid substitution relative to SEQ ID NO: 1342 at one to three amino acid positions selected from positions 2, 5, 6, 8, 9, 12, 13 and 14. In some embodiments the substitutions at positions 2, 5, 6, 8, 9, 12, 13 and 14 of SEQ ID NO: 1342 are conservative amino acid substitutions. In some embodiments the amino acids corresponding to positions 16, 17, 20, 21, 24 or 29 of the native peptide, and more particularly at position 21 and/or 24 are substituted with cysteine or lysine, wherein a PEG chain is covalently attached to the substituted cysteine or lysine residue.

In accordance with some embodiments the modified Class 4 peptide comprises two or more polyethylene glycol chains covalently bound to the peptide wherein the total molecular weight of the glucagon chains is about 1,000 to about 5,000 Daltons. In some embodiments the pegylated Class 4 peptide comprises a peptide selected from the group consisting of SEQ ID NO: 1312, and SEQ ID NO: 1322, wherein said peptide comprise a polyethylene glycol chain linked to the amino acid at positions 11 and 19 and the combined molecular weight of the two PEG chains is about 1,000 to about 5,000 Daltons.

In accordance with some embodiments a Class 4 peptide is provided comprising a modified glucagon peptide selected from the group consisting of:

```
                                                                    (SEQ ID NO: 1309)
R₁-Phe-Thr-Ser-Xaa-Tyr-Ser-Xaa-Tyr-Leu-Xaa-Xaa-Arg-Arg-Ala-Gln-Asp-Phe-Val-

Gln-Trp-Leu-Xaa-Asn-Thr-R₂, (SEQ ID NO: 1310)
R₁-Phe-Thr-Ser-Xaa-Tyr-Ser-Xaa-Tyr-Leu-Asp-Ser-Arg-Arg-Ala-Gln-Xaa-Phe-Val-

Gln-Trp-Leu-Xaa-Asn-Thr-R₂, (SEQ ID NO: 1311)
R₁-Phe-Thr-Ser-Xaa-Tyr-Ser-Xaa-Tyr-Leu-Asp-Ser-Arg-Arg-Ala-Gln-Asp-Phe-Val-

Xaa-Trp-Leu-Xaa-Asn-Thr-R₂
and
```

```
                                                      (SEQ ID NO: 1312)
R₁-Phe-Thr-Ser-Xaa-Tyr-Ser-Xaa-Tyr-Leu-Asp-Ser-Arg-Arg-Ala-Gln-Xaa-Phe-Val-

Xaa-Trp-Leu-Xaa-Asn-Thr-R₂,
``` wherein Xaa at position 4=aspartic acid, glutamic acid, cysteic acid or homocysteic acid, Xaa at position 7=Lys or Arg, Xaa at position 10 is aspartic acid, cysteic acid, glutamic acid, homoglutamic acid and homocysteic acid; Xaa at position 11 is Ser, Lys, Cys, Orn, homocysteine or acetyl phenylalanine, Xaa at position 16 is Asp, Lys, Cys, Orn, homocysteine or acetyl phenylalanine a and Xaa at position 19 is Gln, Lys, Cys, Orn, homocysteine and acetyl phenylalanine, Xaa at position 22=Met, Leu or Nle, $R_1$ is OH or $NH_2$, and $R_2$ is COOH or $CONH_2$, wherein the peptide is pegylated at position 11 for SEQ ID NO: 1309, at position 16 for SEQ ID NO: 1310, position 19 for SEQ ID NO: 1311 and at positions 16 and 19 of SEQ ID NO: 1312, with the proviso that when Xaa at position 4=aspartic acid then $R_1$ is OH. In accordance with some embodiments the peptide comprises the sequence of SEQ ID NO: 1309, SEQ ID NO: 1310 or SEQ ID NO: 1311, wherein $R_1$ is OH and $R_2$ is $CONH_2$. In some embodiments the peptide comprises the sequence of SEQ ID NO: 1309, SEQ ID NO: 1310 or SEQ ID NO: 1311, wherein $R_1$ is OH, $R_2$ is $CONH_2$ and the amino acid at position 4 is aspartic acid, and in a further embodiment such peptides comprise a carboxy terminal extension comprising the sequence of SEQ ID NO: 1319.

In accordance with some embodiments the peptide comprises a sequence selected from the group consisting of SEQ ID NO: 1309, SEQ ID NO: 1310, SEQ ID NO: 1313, SEQ ID NO: 1314, and SEQ ID NO: 1316, wherein the peptide is pegylated at position 11 for SEQ ID NO: 1309 and SEQ ID NO: 1313, pegylated at position 16 for SEQ ID NO: 1310, and pegylated at position 19 for SEQ ID NO: 1310 and SEQ ID NO: 1314. In some embodiments the glucagon agonist comprises the peptide of SEQ ID NO: 1313 or SEQ ID NO: 1314. In some embodiments the C-terminal amino acid of the Class 4 peptides disclosed herein have an amide group in place of the carboxylic acid group that is present on the native amino acid. In accordance with some embodiments the Class 4 peptide comprises the sequence of SEQ ID NO: 1318.

In accordance with some embodiments, a Class 4 peptide is provided wherein a plasma protein has been covalently linked to an amino acid side chain of the peptide to improve the solubility, stability and/or pharmacokinetics of the glucagon peptide. For example, serum albumin can be covalently bound to the Class 4 peptides presented herein. In some embodiments the plasma protein is covalently bound to an amino acid corresponding to position 16, 17, 20, 21, 24 or 29 of the native glucagon peptide. More particularly, in some embodiments the plasma protein is bound to an amino acid corresponding to position 16 or 24 of the native glucagon peptide, wherein the Class 4 peptide comprises the sequence of SEQ ID NO: 1303, SEQ ID NO: 1304, SEQ ID NO: 1305, SEQ ID NO: 1306, SEQ ID NO: 1307, SEQ ID NO: 1308, SEQ ID NO: 1309, SEQ ID NO: 1311, SEQ ID NO: 1312, SEQ ID NO: 1322, SEQ ID NO: 1323, SEQ ID NO: 1324, SEQ ID NO: 1325, SEQ ID NO: 1326, SEQ ID NO: 1327, SEQ ID NO: 1328, SEQ ID NO: 1336 and SEQ ID NO: 1339. In some embodiments the Class 4 peptide comprises a peptide selected from the group consisting of SEQ ID NO: 1309, SEQ ID NO: 1310, SEQ ID NO: 1311 and SEQ ID NO: 1312.

In accordance with some embodiments, a Class 4 peptide is provided wherein a linear amino acid sequence representing the Fc portion of an immunoglobin molecule has been covalently linked to an amino acid side chain of a Class 4 peptide disclosed herein to improve the solubility, stability and/or pharmacokinetics of the glucagon peptide. For example, the amino acid sequence representing the Fc portion of an immunoglobin molecule can be covalently bound to position 11, 12, 15, 16, 19, 21 or 24 of the glucagon peptide of SEQ ID NO: 1307, SEQ ID NO: 1339, or a glucagon analog thereof. In some embodiments the Fc peptide is covalently bound to position 11 or 19 of the Class 4 peptide of SEQ ID NO: 1306, SEQ ID NO: 1307, SEQ ID NO: 1308 or SEQ ID NO: 1336. The Fc portion is usually isolated from IgG, but the Fc peptide fragment from any immunoglobin should function equivalently. In some embodiments the glucagon peptide is selected from the group consisting of SEQ ID NO: 1303, SEQ ID NO: 1304, SEQ ID NO: 1305, SEQ ID NO: 1307 SEQ ID NO: 1308, and SEQ ID NO: 1339, wherein the Fc portion is linked to the corresponding position of 16, 17, 20, 21, 24 or 29 of the native glucagon peptide. In some embodiments the Class 4 peptide comprises a glucagon peptide selected from the group consisting of SEQ ID NO: 1309, SEQ ID NO: 1310, SEQ ID NO: 1311 and SEQ ID NO: 1312, wherein the Fc peptide is bound to the side chain of the amino acid located at position 11, 16 or 19 of SEQ ID NO: 1309, SEQ ID NO: 1310, SEQ ID NO: 1311, respectively, and at both positions 11 and 19 for SEQ ID NO: 1312.

In certain embodiments of the invention, the Class 4 peptide comprises the amino acid sequence of any of SEQ ID NOs: 1362, 1364-1367, and 1371.

Modifications to Improve Solubility

The Class 4 peptides can be further modified to improve the peptide's solubility in aqueous solutions at physiological pH, while, in some aspects retaining a glucagon antagonist activity. Introduction of hydrophilic groups at positions corresponding to positions 1, 16, 17, 20, 21, 24 and 29 of the native peptide, or at the C-terminus, can improve the solubility of the resulting Class 4 peptide in solutions having a physiological pH, while retaining the parent compounds antagonist activity. Therefore, in some embodiments the presently disclosed Class 4 peptides are further modified to comprise one or more hydrophilic groups covalently linked to the side chains of amino acids corresponding to amino acid positions 1, 16, 17, 20, 21, 24 and 29 of the native glucagon peptide or of the N- or C-terminal amino acid. In a further embodiment the side chains of amino acids corresponding to amino acid positions 16 and 24 of the native glucagon peptide are covalently bound to hydrophilic groups, and in some embodiments the hydrophilic group is polyethylene glycol (PEG).

Applicants have also discovered that native glucagon can be modified by introducing charge at its carboxy terminus to enhance the solubility of the peptide while retaining the agonist properties of the peptide. The enhanced solubility allows for the preparation and storage of glucagon solutions at near neutral pH. Formulating glucagon solutions at relatively neutral pHs (e.g. pH of about 6.0 to about 8.0) improves the long term stability of the Class 4 peptides.

Again, applicants anticipate that the Class 4 peptides disclosed herein can be similarly modified to enhance their solubility in aqueous solutions at relatively neutral pH (e.g. pH of about 6.0 to about 8.0) while retaining the antagonist properties of the parent protein. Accordingly, some embodiments of the present invention is directed to a Class 4 peptide of SEQ ID NO: 1339 that has been further modified relative to the native amino acids present at positions 6-29 of the wild type glucagon (SEQ ID NO: 1301) to add charge to the peptide by the substitution of native non-charged amino acids with charged amino acids, or the addition of charged amino acids to the carboxy terminus. In accordance with some embodiments, one to three of the non-charged native amino acids of the Class 4 peptide of SEQ ID NO: 1339 are replaced with a charged amino acid. In some embodiments the charged amino acid is selected from the group consisting of lysine, arginine, histidine, aspartic acid and glutamic acid. More particularly, applicants have discovered that substituting the normally occurring amino acid at corresponding position 28 and/or 29 relative to native glucagon with charged amino acids, and/or the addition of one to two charged amino acids at the carboxy terminus of the Class 4 peptide, enhances the solubility and stability of the Class 4 peptides in aqueous solutions at physiologically relevant pHs (i.e., a pH of about 6.5 to about 7.5). Accordingly, such modifications of the Class 4 peptide disclosed herein are anticipated to have a similar effect on the solubility in aqueous solutions, particularly at a pH ranging from about 5.5 to about 8.0, while retaining the parent peptide's biological activity In accordance with some embodiments the Class 4 peptide of SEQ ID NO: 1339 is modified by the substitution of the native amino acid at corresponding position 28 and/or 29 relative to native glucagon with a negatively charged amino acid (e.g., aspartic acid or glutamic acid) and optionally the addition of a negatively charged amino acid (e.g., aspartic acid or glutamic acid) to the carboxy terminus of the peptide. In an alternative embodiment the Class 4 peptide of SEQ ID NO: 1339 is modified by the substitution of the native amino acid at corresponding position 29 relative to native glucagon with a positively charged amino acid (e.g., lysine, arginine or histidine) and optionally the addition of one or two positively charged amino acid (e.g., lysine, arginine or histidine) on the carboxy terminus of the peptide. In accordance with some embodiments a Class 4 peptide having improved solubility and stability is provided wherein the peptide comprises the amino acid sequence of SEQ ID NO: 1341 with the proviso that at least one amino acids at position, 23, or 24 of SEQ ID NO: 1341 is substituted with an acidic amino acid, and/or an additional acidic amino acid is added at the carboxy terminus of SEQ ID NO: 1341. In some embodiments the acidic amino acids are independently selected from the group consisting of Asp, Glu, cysteic acid and homocysteic acid.

In accordance with some embodiments a Class 4 peptide having improved solubility and stability is provided wherein the antagonist comprises the amino acid sequence of SEQ ID NO: 1341, SEQ ID NO: 1342, SEQ ID NO: 1343 or SEQ ID NO: 1344, wherein at least one of the amino acids at positions 23 or 24 is substituted with a non-native amino acid residue (i.e. at least one amino acid present at position 23 or 24 of the analog is an acidic amino acid different from the amino acid present at the corresponding position in SEQ ID NO: 1307). In accordance with some embodiments a glucagon agonist is provided comprising the sequence of SEQ ID NO: 1341 or 1342 with the proviso that when the amino acid at position 23 is asparagine and the amino acid at position 24 is threonine, the peptide further comprises one to two amino acids, independently selected from the group consisting of Lys, Arg, His, Asp or Glu, added to the carboxy terminus of the Class 4 peptide.

In another embodiment the solubility of the Class 4 peptide of SEQ ID NO: 1342 can be improved by covalently linking a hydrophilic moiety to an amino acid residue at position 11, 12, 15, 16, 19 or 24, and in some embodiments the hydrophilic moiety is linked to an amino acid at position 11, 16 or 19, and in a further embodiment the hydrophilic moiety is linked to amino acid 19. In some embodiments the hydrophilic moiety is a plasma protein or the Fc portion of an immunoglobin, and in an alternative embodiment the hydrophilic moiety is a hydrophilic hydrocarbon chain. In some embodiments the hydrophilic moiety is polyethylene glycol, having a molecular weight selected from the range of about 1,000 to about 5,000 Daltons. In another embodiment the hydrophilic moiety is polyethylene glycol, having a molecular weight of at least about 20,000 Daltons. In some embodiments the polyethylene modified Class 4 peptide comprises the amino acids sequence of SEQ ID NO: 1309, SEQ ID NO: 1310, SEQ ID NO: 1311, SEQ ID NO: 1312, SEQ ID NO: 1343, SEQ ID NO: 1344 or SEQ ID NO: 1345.

Modifications to Improve Stability

The Asp-Ser sequence at position 15-16 of native glucagon has been identified as a uniquely unstable dipeptide that leads to premature chemical cleavage of the native hormone in aqueous buffers. For example, when maintained at 0.01N HCl at 37° C. for 2 weeks, more than 50% of the native glucagon may be cleaved into fragments. The two liberated cleavage peptides 1-15 and 16-29 are devoid of glucagon-like biological activity and thus represent a limitation on the aqueous pre-formulation of glucagon and its related analogs. The selective chemical substitution of the Asp at position 15 of the native glucagon peptide with Glu has been observed to virtually eliminate chemical cleavage of the 15-16 peptide bond.

Accordingly, it is expected that the Class 4 peptides of the present invention can be similarly modified to decrease their susceptibility to premature chemical cleavage in aqueous buffers. In accordance with some embodiments the Class 4 peptides described herein can be further modified to enhance their stability in aqueous solutions by replacing the native aspartic amino acid, located at position 15 of the native glucagon peptide, with an amino acid selected from the group consisting of cysteic acid, glutamic acid, homoglutamic acid and homocysteic acid. In accordance with some embodiments the aspartic acid residue at position 10 of the Class 4 peptide of SEQ ID NO: 1339 can be substituted with an amino acid selected from the group consisting of cysteic acid, glutamic acid, homoglutamic acid and homocysteic acid, and in some embodiments the native aspartic acid at position 10 of SEQ ID NO: 1339 is replaced with glutamic acid. In accordance with some embodiments a Class 4 peptide having improved stability in aqueous solutions is provided wherein the antagonist comprises a sequence selected from the group consisting of SEQ ID NO: 1336, SEQ ID NO: 1340 and SEQ ID NO: 1342. In a further embodiment the Class 4 peptide is amidated.

In accordance with some embodiments, increased stability by way of reduced degradation of the Class 4 peptide described herein may also be achieved by substitution of the serine at position 16 (according to the numbering of native glucagon) with glutamic acid, cysteic acid, homo-glutamic acid, or homo-cysteic acid. In a specific embodiment, the serine at position 16 (according to the native glucagon sequence numbering) is replaced with glutamic acid. In a more specific aspect, the Class 4 peptide comprising such a modification comprises a C-terminal carboxylate and is not amidated.

In accordance with some embodiments, a Class 4 peptide is provided comprising a glucagon peptide selected from the group consisting of SEQ ID NO: 1307, SEQ ID NO: 1336, SEQ ID NO: 1339, SEQ ID NO: 1340, SEQ ID NO: 1341, SEQ ID NO: 1342, SEQ ID NO: 1343 and SEQ ID NO: 1344, further modified by one or more additional amino acid substitutions at positions corresponding to positions 11, 12, 15, 16, 19 and/or 24 of the native glucagon peptide, wherein the amino acid substitutions comprise a substitution with an amino acid having a side chain suitable for crosslinking with hydrophilic moieties, including for example, PEG. The peptide can be substituted with a naturally occurring amino acid or a synthetic (non-naturally occurring) amino acid. Synthetic or non-naturally occurring amino acids refer to amino acids that do not naturally occur in vivo but which, nevertheless, can be incorporated into the peptide structures described herein. In some embodiments a Class 4 peptide is provided wherein the peptide comprises the sequence of SEQ ID NO: 1307, SEQ ID NO: 1336, SEQ ID NO: 1339, SEQ ID NO: 1340, SEQ ID NO: 1341, SEQ ID NO: 1342, SEQ ID NO: 1343 and SEQ ID NO: 1344, and further comprises a polyethylene glycol chain bound to corresponding position 21 or 24 of the native glucagon peptide. In a further embodiment the C-terminus of the Class 4 peptide is modified to replace the carboxylic acid group with an amide group.

Fusion Peptides and Conjugates

The present disclosure also encompasses Class 4 peptide fusion peptides wherein a second peptide has been fused to the C-terminus of the Class 4 peptide. More particularly, the fusion peptide may comprise a Class 4 peptide peptide of SEQ ID NO: 1344 that further comprises an amino acid sequence of SEQ ID NO: 1319 (GPSSGAPPPS), SEQ ID NO: 1320 (Lys Arg Asn Arg Asn Asn Ile Ala) or SEQ ID NO: 1321 (Lys Arg Asn Arg) linked to the c-terminal amino acid of the Class 4 peptide. In some embodiments the amino acid sequence of SEQ ID NO: 1319 (GPSSGAPPPS) is bound to amino acid 24 of the Class 4 peptide of SEQ ID NO: 1342 through a peptide bond. In another embodiment the fusion peptide comprises a Class 4 peptide peptide of SEQ ID NO: 1307, SEQ ID NO: 1336, SEQ ID NO: 1339, SEQ ID NO: 1340, SEQ ID NO: 1341 or SEQ ID NO: 1343 that further comprises an amino acid sequence of SEQ ID NO: 1319 (GPSSGAPPPS) linked to amino acid 24 of the Class 4 peptide. In another embodiment the fusion peptide comprises a Class 4 peptide peptide of SEQ ID NO: 1307, SEQ ID NO: 1336, SEQ ID NO: 1337, SEQ ID NO: 1338, SEQ ID NO: 1339, SEQ ID NO: 1341 or SEQ ID NO: 1343 that further comprises an amino acid sequence of SEQ ID NO: 1320, SEQ ID NO: 1321 or SEQ ID NO: 1353 linked to amino acid 24 of the Class 4 peptide. In some embodiments the Class 4 peptide fusion peptide comprises a sequence selected from the group consisting of SEQ ID NO: 1346 and SEQ ID NO 1347. In a further embodiment the C-terminus of the fusion peptide is modified to replace the carboxylic acid group with an amide group.

In some embodiments a Class 4 peptide fusion peptide is provided wherein the Class 4 peptide portion of the fusion peptide is selected from the group consisting of SEQ ID NO: 1303, SEQ ID NO: 1304, SEQ ID NO: 1305, SEQ ID NO: 1306, SEQ ID NO: 1307, SEQ ID NO: 1308, SEQ ID NO: 1309, SEQ ID NO: 1311, SEQ ID NO: 1312, SEQ ID NO: 1313, SEQ ID NO: 1314, SEQ ID NO: 1315, SEQ ID NO: 1310, SEQ ID NO: 1316, SEQ ID NO: 1317, SEQ ID NO: 1318 and SEQ ID NO: 1339 and the sequence of SEQ ID NO: 1319 is fused to the carboxy terminus of the Class 4 peptide portion, and wherein the PEG chain, when present, is selected from the range of 500 to 40,000 Daltons. More particularly, in some embodiments the Class 4 peptide segment is selected from the group consisting of SEQ ID NO: 1313, SEQ ID NO: 1314, SEQ ID NO: 1315, SEQ ID NO: 1316, SEQ ID NO: 1346 and SEQ ID NO: 1347 wherein the PEG chain is selected from the range of about 500 to about 5,000 Daltons, and more particularly, in some embodiments the PEG chain is about 1,000 Daltons. In a further embodiment the C-terminus is modified to replace the carboxylic acid group with an amide group.

The Class 4 peptide may further comprise one to two charged amino acids added to the carboxy terminus. In some embodiments, wherein one to two charged amino acids are added to the carboxy terminus of SEQ ID NO: 1344, the amino acids are negatively charged amino acids, including for example glutamic acid and aspartic acid. In some embodiments, the Class 4 peptide comprises the sequence of SEQ ID NO: 1342 wherein at least one of corresponding positions 27 and 28 relative to the native glucagon peptide comprises an amino acid selected from the group consisting of aspartic acid and glutamic acid and wherein SEQ ID NO: 1342 is optionally modified to include an addition one to two negatively charged amino acids added to the carboxy terminus. In some embodiments the negatively charged amino acids are glutamic acid or aspartic acid.

The Class 4 peptides disclosed herein can be combined with other active agents, including for example, insulin, to treat diseases or conditions that are characterized by excessive glucagon activity. In some embodiments, Class 4 peptides that have been modified to be covalently bound to a PEG chain having a molecular weight of greater than 10,000 Daltons can be administered in conjunction with insulin to help to maintain stable blood glucose levels in diabetics. The Class 4 peptides of the present disclosure can be co-administered with insulin as a single composition, simultaneously administered as separate solutions, or alternatively, the insulin and the Class 4 peptide can be administered at different times relative to one another. In some embodiments the composition comprising insulin and the composition comprising the Class 4 peptide are administered within 12 hours of one another. The exact ratio of the Class 4 peptide relative to the administered insulin will be dependent in part on determining the glucagon levels of the patient, and can be determined through routine experimentation.

Dimer Peptides

The present disclosure also encompasses multimers of the modified Class 4 peptides disclosed herein. Two or more of the modified Class 4 peptides can be linked together using standard linking agents and procedures known to those skilled in the art. For example, dimers can be formed between two modified Class 4 peptides through the use of bifunctional thiol crosslinkers and bi-functional amine crosslinkers, particularly for Class 4 peptides that have been substituted (at positions 11, 16 or 19, for example) with cysteine, lysine ornithine, homocysteine or acetyl phenylalanine residues (e.g. SEQ ID NO: 1309, SEQ ID NO: 1310, SEQ ID NO: 1311 and SEQ ID NO: 1312). The dimer can be a homodimer or alternatively can be a heterodimer. In some embodiments the dimer is formed between two Class 4 peptides independently selected from the group consisting of SEQ ID NO: 1308, SEQ ID NO: 1309, SEQ ID NO: 1310, SEQ ID NO: 1311, SEQ ID NO: 1312, SEQ ID NO: 1345, SEQ ID NO: 1346, or SEQ ID NO: 1347, wherein the two peptides are linked to one another via a linker attached to position 11 of each peptide, 16 of each peptide, or position 19 of each peptide or any combination thereof. In some embodiments the linkage is a disulfide linkage between a Cys11 to Cys11 or a Cys19 to Cys19 or a Cys11 to Cys19 residue of the respective Class 4 peptide peptides.

Similarly, a dimer can be formed between two Class 4 peptide peptides independently selected form the group consisting of SEQ ID NO: 1303, SEQ ID NO: 1304, SEQ ID NO:

1305, SEQ ID NO: 1306, SEQ ID NO: 1307, SEQ ID NO: 1308, SEQ ID NO: 1309, SEQ ID NO: 1310, SEQ ID NO: 1311, SEQ ID NO: 1312, SEQ ID NO: 1336, SEQ ID NO: 1337, SEQ ID NO: 1338, SEQ ID NO: 1339 and SEQ ID NO: 1342 wherein the linkage is formed between amino acid positions independently selected from positions 16, 21 and 24 with respect to the native glucagon peptide.

In accordance with some embodiments a Class 4 peptide dimer is provided comprising two Class 4 peptides, each comprising the sequence of SEQ ID NO: 1346, wherein the two antagonists are linked to one another by a disulfide bond through amino acid position 25. In another embodiment a Class 4 peptide dimer is provided comprising two Class 4 peptides, each comprising the sequence of SEQ ID NO: 1347, wherein the two antagonists are linked to one another by a disulfide bond through amino acid position 35. In some embodiments the dimer is formed from Class 4 peptides of SEQ ID NO: 1346 and SEQ ID NO: 1347 wherein the amino acid at position 10 is glutamic acid.

In some embodiments the dimer comprises a homodimer of a Class 4 peptide fusion peptide selected from the group consisting of SEQ ID NO: 1307, SEQ ID NO: 1308, SEQ ID NO: 1336, SEQ ID NO: 1337, SEQ ID NO: 1340, SEQ ID NO: 1339, NO: 1340, SEQ ID NO: 1341, SEQ ID NO: 1342 and pharmaceutically acceptable salts of said Class 4 peptides. In accordance with some embodiments a dimer is provided comprising a first Class 4 peptide bound to a second Class 4 peptide via a linker, wherein the first and second peptides of the dimer are independently selected from the group consisting of SEQ ID NO: 1307, SEQ ID NO: 1308, SEQ ID NO: 1336, SEQ ID NO: 1337, SEQ ID NO: 1339, SEQ ID NO: 1340, SEQ ID NO: 1341, and SEQ ID NO: 1342, and pharmaceutically acceptable salts of said glucagon polypeptides. In another embodiment the first and second Class 4 peptides of the dimer are independently selected from the group consisting of SEQ ID NO: 1307, SEQ ID NO: 1308, SEQ ID NO: 1336 and SEQ ID NO: 1339.

In another embodiment the dimer comprises a homodimer of a Class 4 peptide selected from the group consisting of SEQ ID NO: 1323, SEQ ID NO: 1324, SEQ ID NO: 1325, SEQ ID NO: 1326, SEQ ID NO: 1327, SEQ ID NO: 1328, SEQ ID NO: 1329, SEQ ID NO: 1330, SEQ ID NO: 1331. In another embodiment, a Class 4 peptide dimer is provided wherein the first and second peptides of the dimer comprise an amino acid sequence independently selected from the group consisting of SEQ ID NO: 1323, SEQ ID NO: 1324, SEQ ID NO: 1325, SEQ ID NO: 1326, SEQ ID NO: 1327 and SEQ ID NO: 1328. In another embodiment the dimer comprises a homodimer of a Class 4 peptide selected from the group consisting of SEQ ID NO: 1309, SEQ ID NO: 1311 and SEQ ID NO: 1312, wherein the peptide further comprises a polyethylene glycol chain covalently bound to position 11 or 19 of the glucagon peptide.

The Class 4 glucagon related peptide may comprise the amino acid sequence of any of SEQ ID NOs: 1301-1371, optionally with up to 1, 2, 3, 4, or 5 further modifications that retain glucagon antagonist activity.

Class 5 Glucagon Related Peptides

In certain embodiments, a glucagon related peptide is a class 5 glucagon related peptide (see, e.g., International (PCT) Patent Application No. PCT/US2008/081333, incorporated herein by reference in its entirety).

All biological sequences referenced in the following section (SEQ ID NOs: 1401-1518) correspond to SEQ ID NOs.: 1-118 in International Patent Application No. PCT/US2008/081333.

Activity

In certain aspects a class 5 glucagon related peptide (hereafter referred to as a "class 5 peptide") may be a glucagon antagonist/GLP-1 agonist. Glucagon antagonists/GLP-1 agonists are utilized in any setting where the suppression of glucagon agonism is desired while simultaneous stimulation of GLP-1 activity is also desired. For example, glucagon antagonist activity in conjunction with GLP-1 stimulation can be used in the treatment of diabetes where glucagon antagonism has been demonstrated in pre-clinical models of hyperglycemia to yield a lowering of blood glucose and GLP-1 activity is associated with insulin production. Compounds demonstrating GLP-1 activity have also been known to be useful for treating obesity and preventing weight gain.

In certain aspects class 5 peptides are believed to be suitable for any use that has previously been described for other glucagon antagonist/GLP-1 agonists. These two activities have separately been shown to be highly desirable properties for the treatment of the metabolic syndrome, specifically diabetes and obesity. The glucagon antagonist activity is useful in any setting where the suppression of glucagon agonism is desired. The presence of GLP-1 agonism further suppresses the endogenous secretion of glucagon from the pancreas while stimulating insulin synthesis and secretion. The two pharmacological actions serve in a synergistic fashion to normalize metabolic abnormalities. Accordingly, the Class 5 peptides can be used to treat hyperglycemia, or treat other metabolic diseases that result from high blood levels of glucagon or high blood glucose levels. In accordance with some embodiments the patient to be treated using the glucagon antagonist/GLP-1 agonists such as class 5 peptides disclosed herein is a domesticated animal, and in another embodiment the patient to be treated is a human. Studies suggest that lack of glucagon suppression in diabetic patients contributes to postprandial hyperglycemia in part via accelerated glycogenolysis. Analysis of blood glucose during an Oral Glucose Tolerance Test (OGTT), and in the presence or absence of somatostatin-induced glucagon suppression has shown a significant increase in glucose in subjects with higher glucagon levels. Accordingly, a glucagon antagonist/GLP-1 agonists or Class 5 peptides described herein can be used to treating hyperglycemia, and are expected to be useful for treating a variety of types of diabetes including diabetes mellitus type I, diabetes mellitus type II, or gestational diabetes, either insulin-dependent or non-insulin-dependent, and reducing complications of diabetes including nephropathy, retinopathy and vascular disease.

Such methods for reducing appetite or promoting loss of body weight are expected to be useful in reducing body weight, preventing weight gain, or treating obesity of various causes, including drug-induced obesity, and reducing complications associated with obesity including vascular disease (coronary artery disease, stroke, peripheral vascular disease, ischemia reperfusion, etc.), hypertension, onset of diabetes type II, hyperlipidemia and musculoskeletal diseases.

Pharmaceutical compositions comprising class 5 peptides can be formulated and administered to patients using standard pharmaeuctically acceptable carriers and routes of administration known to those skilled in the art. Accordingly, the present disclosure also encompasses pharmaceutical compositions comprising one or more class 5 peptides disclosed herein in combination with a pharmaceutically acceptable carrier. The pharmaceutical compositions may comprise the class 5 peptides as the sole pharmaceutically active component, or the class 5 peptides can be combined with one or more additional active agents. In accordance with some embodiments a composition is provided comprising a Class 5 peptide and insulin or an insulin analog. Alternatively, a composition is provided for inducing weight loss or preventing weight gain can be provided that comprises the sequence of SEQ ID NO: 1415 or SEQ ID NO: 1451 further comprising the amino acid sequence of SEQ ID NO: 1421 (GPSSGAPPPS) or SEQ ID NO: 1450 linked to amino acid 24 of SEQ ID NO: 1415 or SEQ ID NO: 1451, and an anti-obesity peptide. Suitable anti-obesity peptides include those disclosed in U.S. Pat. Nos. 5,691,309, 6,436,435 or US Patent application 20050176643.

Class 5 Peptide Structure

In accordance with some embodiments a Class 5 peptide is provided comprising a glucagon peptide that has been modified by the deletion of the first 1 to 5 amino acids residues (e.g., first amino acid, first two amino acids, first three amino acids, first four amino acids, first five amino acids) from the N-terminus, and stabilization of the alpha-helix structure in the C-terminal portion of the compound (around amino acid positions 12-29 according to the amino acid numbering of wild type glucagon, SEQ ID NO: 1401), e.g., by the linkage of the side chains of amino acid pairs, selected from positions 12 and 16, 16 and 20, 20 and 24, and 24 and 28 (relative to the native glucagon peptide sequence), to one another through hydrogen-bonding or ionic interactions, such as the formation of salt bridges, or by covalent bonds. Alternatively, stabilization of the alpha-helix around residues 12-29 is achieved through introduction of one or more α,α-disubstituted amino acids at positions that retain the desired activity. In some embodiments, one, two, three, four or more of positions 16, 17, 18, 19, 20, 21, 24 or 29 (according to the amino acid numbering of wild type glucagon) of the Class 5 peptide or analog thereof is substituted with an α,α-disubstituted amino acid. For example, substitution of position 16 (according to the amino acid numbering of wild type glucagon) of a Class 5 peptide or analog thereof with amino iso-butyric acid (AIB) provides a stabilized alpha helix in the absence of a salt bridge or lactam. In some embodiments, one, two, three or more of positions 16, 20, 21 or 24 (according to the amino acid numbering of wild type glucagon) are substituted with AIB In accordance with some embodiments, a class 5 peptide is provided wherein the peptide exhibits at least 80% of the maximum agonism achieved by native GLP-1 at the GLP-1 receptor, and exhibits glucagon antagonist activity that reduces the maximum glucagon-induced cAMP production at the glucagon receptor by at least about 50%, as measured by cAMP production in an in vitro assay. In some embodiments, the class 5 peptide exhibits at least 90% of the activity of native GLP-1 at the GLP-1 receptor, and exhibits glucagon antagonist activity, that reduces the maximum glucagon-induced cAMP production at the glucagon receptor by at least about 80%.

In accordance with some embodiments the class 5 peptide comprises a derivative peptide of SEQ ID NO: 1402 wherein the peptide comprises further amino acid substitutions relative to SEQ ID NO: 1402 at one to three amino acid positions selected from positions 1, 2, 4, 5, 6, 7, 8, 9, 10, 11, 12, 13, 14, 15, 16, 19, 22 and 24, and exhibits at least 90% of the activity of native GLP-1 at the GLP-1 receptor, and exhibits glucagon antagonist activity, that reduces the maximum glucagon-induced cAMP production at the glucagon receptor by at least about 80%.

In some embodiments, the alpha-helix structure in the C-terminal portion of the Class 5 peptide (around amino acids 12-29 according to the amino acid numbering of wild type glucagon) is stabilized by, e.g., formation of a covalent or non-covalent intramolecular bridge, or substitution and/or insertion of amino acids around positions 12-29 with an alpha helix-stabilizing amino acid (e.g., an α,α-disubstituted amino acid). In some embodiments, one, two, three, four or more of positions 16, 17, 18, 19, 20, 21, 24 or 29 (according to the amino acid numbering of wild type glucagon) of the Class 5 peptide or analog thereof is substituted with an α,α-disubstituted amino acid e.g., amino isobutyric acid (AIB). For example, substitution of position 16 (according to the amino acid numbering of wild type glucagon) of a Class 5 peptide or analog thereof with amino iso-butyric acid (AIB) provides a stabilized alpha helix in the absence of a salt bridge or lactam.

In some embodiments the class 5 peptide comprises SEQ ID NO: 1415 or SEQ ID NO: 1451, and more particularly, a sequence selected from the group consisting of SEQ ID NO: 1405, SEQ ID NO: 1406, SEQ ID NO: 1407, SEQ ID NO: 1408, SEQ ID NO: 1409, SEQ ID NO: 1416, SEQ ID NO: 1417, SEQ ID NO: 1418, SEQ ID NO: 1419, SEQ ID NO: 1422, SEQ ID NO: 1423, SEQ ID NO: 1424 and SEQ ID NO: 1425. In further embodiments the class 5 peptide comprises a derivative peptide of SEQ ID NO: 1415 or SEQ ID NO: 1451 wherein the peptide comprises a further amino acid substitution relative to SEQ ID NO: 1415 or SEQ ID NO: 1451 at one to three amino acid positions selected from positions 1, 2, 5, 6, 8, 9, 12, 13 and 14. In some embodiments the substitutions at positions 1, 2, 5, 6, 8, 9, 12, 13 and 14 are conservative amino acid substitutions. In some embodiments the threonine at position 24 of SEQ ID NO: 1405 or SEQ ID NO: 1406 is substituted with glycine.

In accordance with some embodiments the class 5 peptide represents a further modification of the peptide wherein in addition to the N-terminal deletion, the phenylalanine at position 6 of the native glucagon peptide is modified, e.g., to comprise a hydroxyl group in place of the N-terminus amino group. In a further embodiment the natural carboxylic acid of the C-terminal amino acid is replaced with a charge-neutral group, such as an amide or ester.

In accordance with some embodiments, Class 5 peptides have been prepared wherein the first three to five amino acids of native glucagon have been deleted, the amino acid at position 9, relative to the native glucagon peptide, has been substituted with an amino acid selected from the group consisting of glutamic acid, homoglutamic acid, β-homoglutamic acid, a sulfonic acid derivative of cysteine, or an alkylcarboxylate derivative of cysteine having the structure of:

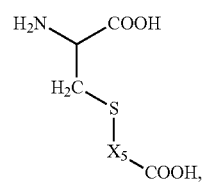

wherein $X_5$ is $C_1$-$C_4$ alkyl, $C_2$-$C_4$ alkenyl, or $C_2$-$C_4$ alkynyl, and the alpha-helix structure in the C-terminal portion of glucagon (around amino acids 12-29 according to the amino acid numbering of wild type glucagon) is stabilized, e.g., via a lactam bridge is formed between the side chains of amino acids 12 and 16 or between amino acids 16 and 20, relative to the native glucagon peptide. Examples of amino acid pairings that are capable of covalently bonding to form a seven-atom linking bridge are detailed through-out this disclosure. In some embodiments, the sulfonic acid derivative of cysteine is cysteic acid or homocysteic acid.

In some embodiments a class 5 is provided comprising an amino acid sequence selected from the group consisting of SEQ ID NO: 1405, SEQ ID NO: 1406, SEQ ID NO: 1407, or SEQ ID NO: 1408, wherein said peptide comprises a lactam ring formed between the side chains of amino acids 7 and 11 for SEQ ID NO: 1405, between 11 and 15 for SEQ ID NO: 1406, between positions 15 and 19 for SEQ ID NO: 1407 and between positions 19 and 24 for SEQ ID NO: 1408, each of said sequences being further modified to comprise a hydrophilic moiety covalently bound to the peptide. More particularly, in some embodiments each of the lactam bearing class 5 peptide are modified by covalent attachment of a polyethylene glycol chain. For example, for a class 5 peptide comprising SEQ ID NO: 1405, the peptide is pegylated at a position selected from the group consisting of 12, 15, 16, 19 and 24; for a class 5 peptide comprising SEQ ID NO: 1406, the peptide is pegylated at a position selected from the group consisting of 12, 16, 19 and 24; for a class 5 peptide comprising SEQ ID NO: 1407, the peptide is pegylated at a position selected from the group consisting of 11, 12, 16 and 24; for class 5 peptide comprising SEQ ID NO: 1408, the peptide is pegylated at a position selected from the group consisting of 11, 12, 15 and 16. In accordance with some embodiments a class 5 peptide comprising SEQ ID NO: 1447 or SEQ ID NO: 1448 is provided wherein the petide is pegylated at a position selected from the group consisting of 12, 16, 19 and 24, relative to the SEQ ID NO: 1447 or SEQ ID NO: 1448 sequence. In a further embodiment the peptide of SEQ ID NO: 1447 or SEQ ID NO: 1448 is further modified by the addition of the sequence of SEQ ID NO: 1421 to the carboxy terminus of the peptide.

As detailed above in certain aspects Class 5 peptides are provided wherein the first five amino acids of native glucagon have been deleted, the amino group of the N-terminal amino acid (phenylalanine) has been replaced with a hydroxyl group (i.e., the first amino acid is phenyl-lactic acid) and the side chains of one or more amino acid pairs selected from positions 12 and 16, 16 and 20, 20 and 24, and 24 and 28 are linked to one another, thus stabilizing the Class 5 peptide alpha helix.

In accordance with some embodiments a class 5 peptide is provided comprising the sequence of SEQ ID NO: 1402 that is modified by a substitution of the serine residue at position 11 of SEQ ID NO: 1402 (position 16 according to the amino acid numbering of native glucagon) with an amino acid selected from the group consisting of glutamic acid, glutamine, homoglutamic acid, homocysteic acid, threonine or glycine. In accordance with some embodiments the serine residue at position 11 of SEQ ID NO: 1402 is substituted with an amino acid selected from the group consisting of glutamic acid, glutamine, homoglutamic acid and homocysteic acid, and in some embodiments the serine residue is substituted with glutamic acid. In accordance with some embodiments the class 5 peptide comprises the sequence of SEQ ID NO: 1438.

In some embodiments a class 5 peptide is provided wherein an intramolecular bridge is formed between two amino acid side chains to stabilize the three dimensional structure of the carboxy terminus of the peptide of SEQ ID NO: 1402. More particularly, the side chains of one or more amino acids selected from amino acid pairs 7 and 11, 11 and 15, 15 and 19 or 19 and 23 of SEQ ID NO: 1402 are linked to one another, thus stabilizing the alpha helix in the C-terminal portion. The two side chains can be linked to one another through hydrogen-bonding, ionic interactions (such as the formation of salt bridges), or by covalent bonds. In accordance with some embodiments the size of the linker is 7-9 atoms, and in some embodiments the size of the linker is 8 atoms. In some embodiments the class 5 peptide is selected from the group consisting of SEQ ID NO: 1405, SEQ ID NO: 1406, SEQ ID NO: 1407 and SEQ ID NO: 1408. In some embodiments the C-terminal amino acid of the class 5 peptide have an amide group substituting for the carboxylic acid group that is present on the native amino acid.

In accordance with some embodiments class 5 peptide is provided wherein the analog comprises an amino acid sequence of SEQ ID NO: 1409. In some embodiments the three dimensional structure of the carboxy terminus of the peptide of SEQ ID NO: 1409 is stabilized by the formation of covalent bonds between the side chains of the peptide. In some embodiments two amino acid side chains are bound to one another to form a lactam ring. The size of the lactam ring can vary depending on the length of the amino acid side chains, and in some embodiments the lactam is formed by linking the side chains of a lysine amino acid to a glutamic acid side chain. In some embodiments the C-terminal amino acid of the class 5 peptides have an amide group substituting for the carboxylic acid group that is present on the native amino acid.

The order of the amide bond in the lactam ring can be reversed (e.g., a lactam ring can be formed between the side chains of a Lys12 and a Glu16 or alternatively between a Glu 12 and a Lys16). In accordance with some embodiments a glucagon analog of SEQ ID NO: 1409 is provided wherein at least one lactam ring is formed between the side chains of an amino acid pair selected from the group consisting of amino acid pairs 7 and 11, 11 and 15, 15 and 19 or 19 and 23 of SEQ ID NO: 1409. In some embodiments a class 5 peptide is provided wherein the peptide comprises the sequence of SEQ ID NO: 1410, said sequence further comprising an intramolecular lactam bridge formed between amino acid positions 7 and 11, or between amino acid positions 11 and 15, or between amino acid positions 15 and 19 of SEQ ID NO: 1410. In some embodiments a class 5 peptide is provided wherein the peptide comprises the sequence of SEQ ID NO: 1411, said sequence further comprising an intramolecular lactam bridge formed between amino acid positions 7 and 11, or between amino acid positions 11 and 15 of SEQ ID NO: 1411. In some embodiments the class 5 peptide comprises the sequence of SEQ ID NO: 1417.

Additional class 5 peptide are provided comprising derivatives of SEQ ID NO: 1405, wherein the aspartic acid at position 10 of SEQ ID NO: 1405 (position 15 of native glucagon) has been substituted with glutamic acid, an amino acid of the general structure:

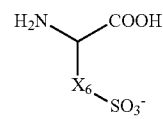

wherein $X_6$ is $C_1$-$C_3$ alkyl, $C_2$-$C_3$ alkene or $C_2$-$C_3$ alkynyl, and in some embodiments $X_6$ is $C_1$-$C_3$ alkyl, and in another embodiment $X_6$ is $C_2$ alkyl. In some embodiments a Class 5 peptide derivative of SEQ ID NO: 1409 is provided wherein position 10 of SEQ ID NO: 1409 (position 15 of native glucagon) is substituted with an amino acid selected from the group consisting of glutamic acid, cysteic acid, homocysteic acid and homoglutamic acid. In a further embodiment position 10 of SEQ ID NO: 1409 is substituted with an amino acid selected from the group consisting of cysteic acid or homocysteic acid. In some embodiments a Class 5 peptide derivative of SEQ ID NO: 1406, SEQ ID NO: 1407 or SEQ ID NO: 1408 is provided wherein position 10 of SEQ ID NO: 1406, SEQ ID NO: 1407 or SEQ ID NO: 1408 is substituted with an amino acid selected from the group consisting of glutamic acid, cysteic acid, homocysteic acid and homoglutamic acid. In some embodiments the C-terminal amino acid of a class 5 peptide have an amide group substituting for the carboxylic acid group that is present on the native amino acid.

In some embodiments an amino acid of class 5 peptide is substituted with at least one cysteine residue, wherein the side chain of the cysteine residue is further modified with a thiol reactive reagent, including for example, maleimido, vinyl sulfone, 2-pyridylthio, haloalkyl, and haloacyl. These thiol reactive reagents may contain carboxy, keto, hydroxyl, and ether groups as well as other hydrophilic moieties such as polyethylene glycol units. In an alternative embodiment, an amino acid of a class 5 peptide is substituted with lysine, and the side chain of the substituting lysine residue is further modified using amine reactive reagents such as active esters (succinimido, anhydride, etc) of carboxylic acids or aldehydes of hydrophilic moieties such as polyethylene glycol. In accordance with some embodiments the lysine residue corresponding to position 7 of the peptide of SEQ ID NO: 1405 is substituted with arginine and a single lysine substitution is inserted for one of the amino acids corresponding to position 12, 15, 16, 19 and 24 of SEQ ID NO: 1405.

In another embodiment the methionine residue corresponding to position 22 of the class 5 peptides disclosed herein is changed to leucine or norleucine to prevent oxidative degradation of the peptide.

Moreover class 5 peptides, in some aspects, also encompass amino acid substitutions at positions that are known not to be critical to the function of the glucagon analog. In some embodiments the substitutions are conservative amino acid substitutions at one, two or three positions selected from the group consisting of 2, 5, 6, 7, 8, 9, 12, 13, 14, 15, 16, 19, 22, 23 or 24. In some embodiments the amino acids corresponding to positions 16, 17, 20, 21, 24 or 29 of the native glucagon peptide, and more particularly at position 21 and/or 24 relative to native glucagon are substituted with cysteine or lysine, wherein a PEG chain is covalently attached to the substituted cysteine or lysine residue.

In accordance with some embodiments, a class 5 peptide is provided comprising a sequence consisting of SEQ ID NO: 1409, further modified by one or more additional amino acid substitutions at positions corresponding to positions 11, 12, 15, 16, 19 and/or 24 of the peptide (including for example substitution with cysteine), wherein the amino acid substitution comprises an amino acid having a side chain suitable for crosslinking with hydrophilic moieties, including for example, PEG. Native glucagon can be substituted with a naturally occurring amino acid or a synthetic (non-naturally occurring) amino acid. Synthetic or non-naturally occurring amino acids refer to amino acids that do not naturally occur in vivo but which, nevertheless, can be incorporated into the peptide structures described herein. In some embodiments a Class 5 peptide is provided wherein the peptide comprises the sequence of SEQ ID NO: 1409 and further comprises a polyethylene glycol chain bound to position 16 or 19 of the peptide. In a further embodiment the C-terminus of the glucagon analog is modified to replace the carboxylic acid group with an amide group.

In accordance with some embodiments a class 5 peptide is provided comprising a glucagon analog selected from the group consisting of:

```
                                                       (SEQ ID NO: 1439)
R1-Phe-Thr-Ser-Xaa-Tyr-Ser-Lys-Tyr-Leu-Xaa-Glu-Arg-Arg-Ala-Gln-Asp-Phe-Val-

Gln-Trp-Leu-Xaa-Asn-Thr-R2

(SEQ ID NO: 1413)
R1-Phe-Thr-Ser-Xaa-Tyr-Ser-Lys-Tyr-Leu-Asp-Glu-Arg-Arg-Ala-Gln-Xaa-Phe-Val-

Gln-Trp-Leu-Xaa-Asn-Thr-R2, (SEQ ID NO: 1414)
R1-Phe-Thr-Ser-Xaa-Tyr-Ser-Lys-Tyr-Leu-Asp-Glu-Arg-Arg-Ala-Gln-Asp-Phe-Val-

Xaa-Trp-Leu-Xaa-Asn-Thr-R2
and (SEQ ID NO: 1412)
R1-Phe-Thr-Ser-Xaa-Tyr-Ser-Lys-Tyr-Leu-Asp-Glu-Arg-Arg-Ala-Gln-Xaa-Phe-Val- Xaa-Trp-Leu-Xaa-Asn-Thr-R2,
``` wherein Xaa at position 4=aspartic acid, glutamic acid, cysteic acid or homocysteic acid, Xaa at position 10=Asp, Glu, cysteic acid, homoglutamic acid and homocysteic acid, Xaa at position 16 is Asp, Cys, Orn, homocysteine or acetyl phenylalanine and the Xaa at position 19 is Gln, Cys, Orn, homocysteine and acetyl phenylalanine, Xaa at position 22=Met, Leu or Nle, $R_1$ is OH or $NH_2$, and $R_2$ is Gly Pro Ser Ser Gly Ala Pro Pro Pro Ser (SEQ ID NO: 1421), Gly Pro Ser Ser Gly Ala Pro Pro Pro Ser Xaa (SEQ ID NO: 1450; wherein Xaa is Cys, Orn, homocystein or acetyl phenylalanine), COOH or $CONH_2$, wherein the peptide is optionally pegylated at position 16 of SEQ ID NO: 1413, position 19 of SEQ ID NO: 1414 and at positions 16 and 19 of SEQ ID NO: 1412. In some embodiments the Thr at position 24 of SEQ ID NOs: 1412-1414 and 1439 is substituted with Gly. In accordance with some embodiments the peptide comprises the sequence of SEQ ID NO: 13 or SEQ ID NO: 1414, wherein $R_1$ is OH. In accordance with some embodiments the peptide comprises the sequence of SEQ ID NO: 1413 or SEQ ID NO: 1414, wherein $R_1$ is OH and $R_2$ is $CONH_2$. In accordance with some embodiments the peptide comprises the sequence of SEQ ID NO: 1413 or SEQ ID NO: 1414, wherein $R_1$ is OH, $R_2$ is $CONH_2$ and the threonine at position 24 is substituted with glycine.

In some embodiments, a class 5 peptide is further modified to comprise one or more amino acids of native GLP-1 by substitution of the native glucagon residue(s) at corresponding amino acid positions. For example, the class 5 peptide may comprise one or more amino acid substitutions at any of positions 2, 3, 17, 18, 21, 23, and 24 (according to the amino acid numbering of native glucagon). In a specific embodiment, the class 5 peptide is modified by one or more of the following amino acid substitutions: Ser2 is replaced with Ala, Gln3 is replaced with Glu, Arg17 is replaced with Gln, Arg at position 18 is replaced with Ala, Asp at position 21 is replaced with Glu, Val at position 23 is replaced with Ile, and Gln at position 24 is replaced with Ala (amino acid positions are in accordance with the native glucagon sequence). In a specific embodiment, the class 5 peptide is modified by replacing Ser2 with Ala and Gln3 with Glu (according to the amino acid numbering of native glucagon). In another specific embodiment, the class 5 peptide is modified with all of the following amino acid substitutions: Arg17 is replaced with Gln, Arg at position 18 is replaced with Ala, Asp at position 21 is replaced with Glu, Val at position 23 is replaced with Ile, and Gln at position 24 is replaced with Ala (amino acid numbering according to native glucagon). In yet another specific embodiment, the class 5 peptide is modified to comprise just Glu at position 21 (according to the numbering of SEQ ID NO: 1401). Accordingly, the class 5 peptide can comprise the amino acid sequence of any of SEQ ID NOs: 1460-1470, 1473-1478, 1480-1488, 1490-1496, 1503, 1504, 1506, and 1514-1518.

Also provided herein is a class 5 peptide or conjugate thereof comprising (1) a stabilized alpha helix through means described herein (e.g., through an intramolecular bridge, or incorporation of one or more alpha, alpha-di-substituted amino acids, or an acidic amino acid at position 16 (according to the numbering of SEQ ID NO:1401), or a combination thereof; (2) a C-terminal amide or ester in place of a C-terminal carboxylate, and (3) a general structure of A-B-C, wherein A is selected from the group consisting of
(i) phenyl lactic acid (PLA);
(ii) an oxy derivative of PLA; and
(iii) a peptide of 2 to 6 amino acids in which two consecutive amino acids of the peptide are linked via an ester or ether bond;

wherein B represents amino acids p to 26 of SEQ ID NO: 1401, wherein p is 3, 4, 5, 6, or 7, optionally comprising one or more amino acid modifications, as described herein, including, for example, any of the modifications described for Class 5 peptides. For instance the one or more modification may be selected from the group consisting of:
(iv) Asp at position 9 (according to the amino acid numbering of SEQ ID NO: 1401) is substituted with a Glu, a sulfonic acid derivative of Cys, homoglutamic acid, β-homoglutamic acid, or an alkylcarboxylate derivative of cysteine having the structure of:

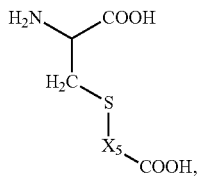

wherein $X_5$ is $C_1$-$C_4$ alkyl, $C_2$-$C_4$ alkenyl, or $C_2$-$C_4$ alkynyl;
(v) substitution of one or two amino acids at positions 10, 20, and 24, (according to the amino acid numbering of SEQ ID NO: 1401) with an amino acid covalently attached to an acyl or alkyl group via an ester, ether, thioether, amide, or alkyl amine linkage;
(vi) substitution of one or two amino acids at positions 16, 17, 20, 21, and 24 (according to the amino acid numbering of SEQ ID NO: 1401) with an amino acid selected from the group consisting of: Cys, Lys, ornithine, homocysteine, and acetyl-phenylalanine (Ac-Phe), wherein the amino acid of the group is covalently attached to a hydrophilic moiety;
(vii) Asp at position 15 (according to the numbering of SEQ ID NO: 1401) is substituted with cysteic acid, glutamic acid, homoglutamic acid, and homocysteic acid;
(viii) Ser at position 16 (according to the numbering of SEQ ID NO: 1401) is substituted with cysteic acid, glutamic acid, homoglutamic acid, and homocysteic acid;
(ix) Arg at position 17 is replaced with Gln, Arg at position 18 is replaced with Ala, Asp at position 21 is replaced with Glu, Val at position 23 is replaced with Ile, and Gln at position 24 is replaced with Ala (according to amino acid numbering of SEQ ID NO: 1401);
(x) Ser at position 16 is replaced with Glu, Gln at position 20 is replaced with Glu, or Gln at position 24 is replaced with Glu (according to the amino acid numbering of SEQ ID NO: 1401);

wherein C (of the general structure of A-B-C) is selected from the group consisting of:
(vii) X;
(viii) X—Y;
(ix) X—Y—Z;
(x) X—Y—Z—R10;

wherein X is Met, Leu, or Nle; Y is Asn or a charged amino acid; Z is Thr, Gly, Cys, Lys, ornithine (Orn), homocysteine, acetyl phenylalanine (Ac-Phe), or a charged amino acid; wherein R10 is selected from a group consisting of SEQ ID NOs: 1421, 1426, 1427, and 1450.

In a specific aspect, the peptide comprises an oxy derivative of PLA. As used herein "oxy derivative of PLA" refers to a compound comprising a modified structure of PLA in which the hydroxyl group has been replaced with O—$R_{11}$, wherein $R_{11}$ is a chemical moiety. In this regard, the oxy derivative of PLA can be, for example, an ester of PLA or an ether of PLA.

Methods of making oxy derivatives of PLA are known in the art. For example, when the oxy derivative is an ester of PLA, the ester may be formed by upon reaction of the hydroxyl of PLA with a carbonyl bearing a nucleophile. The nucleophile can be any suitable nucleophile, including, but not limited to an amine or hydroxyl. Accordingly, the ester of PLA can comprise the structure of Formula IV:

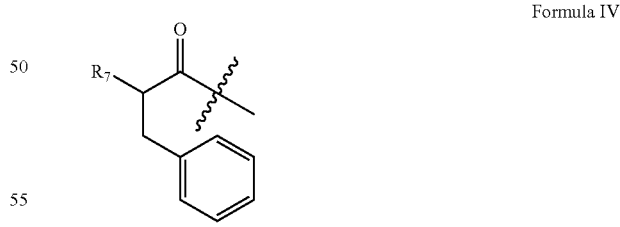

Formula IV wherein R7 is an ester formed upon reaction of the hydroxyl of PLA with a carbonyl bearing a nucleophile.

The carbonyl bearing a nucleophile (which reacts with the hydroxyl of PLA to form an ester) can be, for example, a carboxylic acid, a carboxylic acid derivative, or an activated ester of a carboxylic acid. The carboxylic acid derivative can be, but is not limited to, an acyl chloride, an acid anhydride, an amide, an ester, or a nitrile. The activated ester of a carboxylic acid can be, for example, N-hydroxysuccinimide (NHS), tosylate (Tos), a carbodiimide, or a hexafluorophosphate. In some embodiments, the carbodiimide is 1,3-dicyclohexylcarbodiimide (DCC), 1,1'-carbonyldiimidazole (CDI), 1-ethyl-3-(3-dimethylaminopropyl)carbodiimide hydrochloride (EDC), or 1,3-diisopropylcarbodiimide (DICD). In some embodiments, the hexafluorophosphate is selected from a group consisting of hexafluorophosphate benzotriazol-1-yloxy-tris(dimethylamino)phosphonium hexafluorophosphate (BOP), benzotriazol-1-yl-oxytripyrrolidinophosphonium hexafluorophosphate (PyBOP), 2-(1H-7-azabenzotriazol-1-yl)-1,1,3,3-tetramethyl uronium hexafluorophosphate (HATU), and o-benzotriazole-N,N,N',N'-tetramethyl-uronium-hexafluoro-phosphate (HBTU).

Methods of making ethers from reaction with a hydroxyl group (e.g., the hydroxyl of PLA) also are known in the art. For example, the hydroxyl group of PLA may be reacted with a halogenated alkyl or tosylated alkyl alcohol to form an ether bond.

In a specific embodiment, the chemical moiety bound to PLA via an oxygen-containing bond (e.g., via an ester or ether bond) is a polymer (e.g., a polyalkylene glycol), a carbohydrate, an amino acid, a peptide, or a lipid, e.g., a fatty acid or a steroid.

In a specific embodiment, the chemical moiety is an amino acid, which, optionally, is a part of a peptide, such that Formula IV is a depsipeptide. In this regard, PLA may be at a position other than the N-terminal amino acid residue of the peptide, such that the peptide comprises one or more (e.g., 1, 2, 3, 4, 5, 6, or more) amino acids N-terminal to the PLA residue. For example, the peptide can comprise PLA at position n, wherein n is 2, 3, 4, 5, or 6 of the peptide.

The amino acids N-terminal to the PLA residue may be synthetic or naturally-occurring. In a specific embodiment, the amino acids which are N-terminal PLA are naturally-occurring amino acids. In some embodiments, the amino acids which are N-terminal to PLA are the N-terminal amino acids of native glucagon. For example, the peptide can comprise at the N-terminus the amino acid sequence of any of SEQ ID NOs: 1452-1456, wherein PLA is linked to threonine via an ester bond:

```
His-Ser-Gln-Gly-Thr-PLA       SEQ ID NO: 1452

Ser-Gln-Gly-Thr-PLA           SEQ ID NO: 1453

Gln-Gly-Thr-PLA               SEQ ID NO: 1454

Gly-Thr-PLA                   SEQ ID NO: 1455

Thr-PLA                       SEQ ID NO: 1456
```

In an alternative embodiment, one or more of the N-terminal amino acids may be substituted with an amino acid other than the amino acid of native glucagon. For example, when the peptide comprises PLA as the amino acid at position 5 or 6, the amino acid at position 1 and/or position 2 may be an amino acid which reduces susceptibility to cleavage by dipeptidyl peptidase IV. More particularly, in some embodiments, position 1 of the peptide is an amino acid selected from the group consisting of D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine. More particularly, in some embodiments, position 2 of the antagonist/agonist peptide is an amino acid selected from the group consisting of D-serine, D-alanine, valine, glycine, N-methyl serine, N-methyl alanine, and aminoisobutyric acid (AIB). Also, for example, when the peptide comprises PLA as the amino acid at position 4, 5, or 6, the amino acid at position 3 of the peptide may be glutamic acid, as opposed to the native glutamine residue of native glucagon. In an exemplary embodiment of the invention, the peptide comprises at the N-terminus the amino acid sequence of any of SEQ ID NOs: 1457-1459.

With respect to the peptides comprising a compound of Formula IV, the polymer may be any polymer, provided that it can react with the hydroxyl group of PLA. The polymer may be one that naturally or normally comprises a carbonyl bearing a nucleophile. Alternatively, the polymer may be one which was derivatized to comprise the carbonyl bearing the carbonyl. The polymer may be a derivatized polymer of any of: polyamides, polycarbonates, polyalkylenes and derivatives thereof including, polyalkylene glycols, polyalkylene oxides, polyalkylene terepthalates, polymers of acrylic and methacrylic esters, including poly(methyl methacrylate), poly(ethyl methacrylate), poly(butylmethacrylate), poly(isobutyl methacrylate), poly(hexylmethacrylate), poly(isodecyl methacrylate), poly(lauryl methacrylate), poly(phenyl methacrylate), poly(methyl acrylate), poly(isopropyl acrylate), poly(isobutyl acrylate), and poly(octadecyl acrylate), polyvinyl polymers including polyvinyl alcohols, polyvinyl ethers, polyvinyl esters, polyvinyl halides, poly(vinyl acetate), and polyvinylpyrrolidone, polyglycolides, polysiloxanes, polyurethanes and co-polymers thereof, celluloses including alkyl cellulose, hydroxyalkyl celluloses, cellulose ethers, cellulose esters, nitro celluloses, methyl cellulose, ethyl cellulose, hydroxypropyl cellulose, hydroxy-propyl methyl cellulose, hydroxybutyl methyl cellulose, cellulose acetate, cellulose propionate, cellulose acetate butyrate, cellulose acetate phthalate, carboxylethyl cellulose, cellulose triacetate, and cellulose sulphate sodium salt, polypropylene, polyethylenes including poly(ethylene glycol), poly(ethylene oxide), and poly(ethylene terephthalate), and polystyrene.

The polymer can be a biodegradable polymer, including a synthetic biodegradable polymer (e.g., polymers of lactic acid and glycolic acid, polyanhydrides, poly(ortho)esters, polyurethanes, poly(butic acid), poly(valeric acid), and poly(lactide-cocaprolactone)), and a natural biodegradable polymer (e.g., alginate and other polysaccharides including dextran and cellulose, collagen, chemical derivatives thereof (substitutions, additions of chemical groups, for example, alkyl, alkylene, hydroxylations, oxidations, and other modifications routinely made by those skilled in the art), albumin and other hydrophilic proteins (e.g., zein and other prolamines and hydrophobic proteins)), as well as any copolymer or mixture thereof. In general, these materials degrade either by enzymatic hydrolysis or exposure to water in vivo, by surface or bulk erosion.

The polymer can be a bioadhesive polymer, such as a bioerodible hydrogel described by H. S. Sawhney, C. P. Pathak and J. A. Hubbell in Macromolecules, 1993, 26, 581-587, the teachings of which are incorporated herein, polyhyaluronic acids, casein, gelatin, glutin, polyanhydrides, polyacrylic acid, alginate, chitosan, poly(methyl methacrylates), poly(ethyl methacrylates), poly(butylmethacrylate), poly(isobutyl methacrylate), poly(hexylmethacrylate), poly(isodecyl methacrylate), poly(lauryl methacrylate), poly(phenyl methacrylate), poly(methyl acrylate), poly(isopropyl acrylate), poly(isobutyl acrylate), and poly(octadecyl acrylate).

In some embodiments, the polymer is a water-soluble polymer. Suitable water-soluble polymers are known in the art and include, for example, polyvinylpyrrolidone, hydroxypropyl cellulose (HPC; Klucel), hydroxypropyl methylcellulose (HPMC; Methocel), nitrocellulose, hydroxypropyl ethylcellulose, hydroxypropyl butylcellulose, hydroxypropyl pentylcellulose, methyl cellulose, ethylcellulose (Ethocel), hydroxyethyl cellulose, various alkyl celluloses and hydroxyalkyl celluloses, various cellulose ethers, cellulose acetate, carboxymethyl cellulose, sodium carboxymethyl cellulose, calcium carboxymethyl cellulose, vinyl acetate/crotonic acid copolymers, poly-hydroxyalkyl methacrylate, hydroxymethyl methacrylate, methacrylic acid copolymers, polymethacrylic acid, polymethylmethacrylate, maleic anhydride/methyl vinyl ether copolymers, poly vinyl alcohol, sodium and calcium polyacrylic acid, polyacrylic acid, acidic carboxy polymers, carboxypolymethylene, carboxyvinyl polymers, polyoxyethylene polyoxypropylene copolymer, polymethylvinylether co-maleic anhydride, carboxymethylamide, potassium methacrylate divinylbenzene co-polymer, polyoxyethyleneglycols, polyethylene oxide, and derivatives, salts, and combinations thereof.

In a specific embodiment, the polymer is a polyalkylene glycol, including, for example, polyethylene glycol (PEG).

The carbohydrate may be any carbohydrate provided that it comprises or is made to comprise a carbonyl with an alpha leaving group. The carbohydrate, for example, may be one which has been derivatized to comprise a carbonyl with an alpha leaving group. In this regard, the carbohydrate may be a derivatized form of a monosaccharide (e.g., glucose, galactose, fructose), a disaccharide (e.g., sucrose, lactose, maltose), an oligosaccharide (e.g., raffinose, stachyose), a polysaccharide (a starch, amylase, amylopectin, cellulose, chitin, callose, laminarin, xylan, mannan, fucoidan, galactomannan.

The lipid may be any lipid comprising a carbonyl with an alpha leaving group. The lipid, for example, may be one which is derivatized to comprise the carbonyl. In this regard, the lipid, may be a derivative of a fatty acid (e.g., a C4-C30 fatty acid, eicosanoid, prostaglandin, leukotriene, thromboxane, N-acyl ethanolamine), glycerolipid (e.g., mono-, di-, tri-substituted glycerols), glycerophospholipid (e.g., phosphatidylcholine, phosphatidylinositol, phosphatidylethanolamine, phosphatidylserine), sphingolipid (e.g., sphingosine, ceramide), sterol lipid (e.g., steroid, cholesterol), prenol lipid, saccharolipid, or a polyketide.

oil, wax, cholesterol, sterol, fat-soluble vitamin, monoglyceride, diglyceride, triglyceride, a phospholipid.

In some embodiments, R7 has a molecular weight of about 100 kDa or less, e.g., about 90 kDa or less, about 80 kDa or less, about 70 kDa or less, about 60 kDa or less, about 50 kDa or less, or about 40 kDa or less. Accordingly, R7 can have a molecular weight of about 35 kDa or less, about 30 kDa or less, about 25 kDa or less, about 20 kDa or less, about 15 kDa or less, about 10 kDa or less, about 5 kDa or less, or about 1 kDa.

In an alternative embodiment, the peptide comprising the general structure of A-B-C comprises, as A, a peptide of 2 to 6 amino acids in which two consecutive amino acids of the peptide of A are linked via an ester or ether bond. The ester or ether bond may be, e.g., between amino acids 2 and 3, 3 and 4, 4 and 5, or 5 and 6. Optionally the peptide of A may be further modified by covalent linkage to another chemical moiety including linkage to a polymer (e.g. a hydrophilic polymer), alkylation, or acylation.

In a specific embodiment, the above-described class 5 peptide comprising PLA is modified to comprise an oxy derivative of PLA, such as, for instance, an ester of PLA or an ether of PLA. For example, the class 5 peptide can comprise the amino acid sequence of any of SEQ ID NOs: 1402, 1405-1420, 1422-1425, 1432-1436, 1438, 1439, 1445, 1446, and 1451, wherein the PLA is linked via an ester or ether bond to an amino acid, peptide, polymer, acyl group, or alkyl group.

The amino acid, peptide, polymer, acyl group, or alkyl group may be any of those described herein. In the case that the PLA is linked via an ester bond to an amino acid or peptide, the class 5 peptide may be considered as a depsipeptide.

Also, in another specific embodiment, the above-described class 5 peptide which lacks PLA is modified to comprise at least one ester bond or ether bond between two consecutive amino acids which are N-terminal to the amino acid at position 7 (according to the numbering of native glucagon). In a specific embodiment, the class 5 peptide comprises at least one ester or ether bond between the two consecutive amino acids. In a more specific embodiment, the Class 5 peptide comprises the N-terminal 6 amino acids of SEQ ID NO: 1401 and two consecutive amino acids of the N-terminal 6 amino acids are linked via an ester or ether bond.

The peptide of A may comprise any amino acids, synthetic or naturally occurring, provided that at least two consecutive amino acids are linked via an ester or ether bond. In a specific embodiment, the peptide of A comprises amino acids of native glucagon. The amino acid at position 1 and/or position 2 may be an amino acid which reduces susceptibility to cleavage by dipeptidyl peptidase IV. For instance, the peptide of A can comprise at position 1 an amino acid selected from the group consisting of D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine. More particularly, in some embodiments, position 2 of the peptide of A is an amino acid selected from the group consisting of D-serine, D-alanine, valine, glycine, N-methyl serine, N-methyl alanine, and aminoisobutyric acid (AIB). Also, for example, the amino acid at position 3 of the peptide of A may be glutamic acid, as opposed to the native glutamine residue of native glucagon. Accordingly, the peptide of general structure of A-B-C can comprise an amino acid sequence of:

```
Xaa₁-Xaa₂-Xaa₃-Thr-Gly-Phe;    (SEQ ID NO: 1507)

Xaa₂-Xaa₃-Thr-Gly-Phe;         (SEQ ID NO: 1508)
or

Xaa₃-Thr-Gly-Phe;              (SEQ ID NO: 1509)
``` wherein $Xaa_1$ is selected from a group consisting of: His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and homo-histidine; $Xaa_2$ is selected from a group consisting of: Ser, D-serine, D-alanine, valine, glycine, N-methyl serine, N-methyl alanine, and aminoisobutyric acid (AIB); and $Xaa_3$ is Gln or Glu.

In some embodiments, B is modified by up to three amino acid modifications. For example, B, which represents native amino acid sequence of SEQ ID NO: 1401 is modified by one or more conservative amino acid modifications.

In another embodiment, B comprises one or more amino acid modifications selected from the group consisting of (iv) to (x), as described herein. In a specific embodiment, B comprises one or both of the amino acid modifications (v) and (vi). In a further specific embodiment, B comprises one or a combination of amino acid modifications selected from the group consisting of (iv), (vii), (viii), (ix), and (x), in addition to (v) and (vi).

As described herein, the peptide comprising the general structure A-B-C may comprise one or more charged amino acids at the C-terminus, e.g., as Y and/or Z, as described herein. Alternatively or additionally, the peptide comprising the general structure A-B-C may further comprise one to two charged amino acids C-terminal to Z, when C comprises X—Y—Z. The charged amino acids can be, for example, one of Lys, Arg, His, Asp, and Glu. In a specific embodiment, Y is Asp.

In some embodiments, the peptide comprising the general structure A-B-C comprises a hydrophilic moiety covalently bound to an amino acid residue at position 1, 16, 20, 21, or 24 (according to the amino acid numbering of SEQ ID NO: 1401), or at the N- or C-terminal residue of the peptide comprising the general structure A-B-C. In a specific embodiment, the hydrophilic moiety is attached to a Cys residue of the peptide comprising the general structure A-B-C. In this regard, the amino acid at position 16, 21, 24, or 29 of native glucagon (SEQ ID NO: 1401) may be substituted with a Cys residue. Alternatively, a Cys residue comprising a hydrophilic moiety may be added to the C-terminus of the peptide comprising the general structure A-B-C as position 30 or as position 40, e.g., when the peptide comprising the general structure A-B-C comprises a C-terminal extension (positions according to the amino acid numbering of SEQ ID NO: 1401). Alternatively, the hydrophilic moiety may be attached to the PLA of the peptide comprising the general structure A-B-C via the hydroxyl moiety of PLA. The hydrophilic moiety can be any of those described herein, including, for example, polyethylene glycol.

In a specific aspect, the peptide comprising the general structure A-B-C comprises a stabilized alpha helix by virtue of incorporation of an intramolecular bridge. In some embodiments, the intramolecular bridge is a lactam bridge. The lactam bridge may be between the amino acids at positions 9 and 12, the amino acids at positions 12 and 16, the amino acids at positions 16 and 20, the amino acids at positions 20 and 24, or the amino acids at positions 24 and 28 (according to the amino acid numbering of SEQ ID NO: 1401). In a specific embodiment, the amino acids at positions 12 and 16 or at positions 16 and 20 (according to the amino acid numbering of SEQ ID NO: 1401) are linked via a lactam bridge. Other positions of the lactam bridge are contemplated.

Additionally or alternatively, the peptide comprising the general structure A-B-C can comprise an alpha, alpha di-substituted amino acid at, for example, any of positions 16, 20, 21, or 24 (according to the amino acid numbering of SEQ ID NO: 1401). In some embodiments, the alpha, alpha di-substituted amino acid is AIB. In a specific aspect, the AIB is located at position 16 (according to the numbering of SEQ ID NO: 1401).

Alternatively or additionally, the peptide comprising the general structure A-B-C may be modified to comprise an acidic amino acid at position 16 (according to the numbering of SEQ ID NO: 1401), which modification enhances the stability of the alpha helix. The acidic amino acid, in some embodiments, is an amino acid comprising a side chain sulfonic acid or a side chain carboxylic acid. In a more specific embodiment, the acidic amino acid is selected from the group consisting of Glu, Asp, homoglutamic acid, a sulfonic acid derivative of Cys, cysteic acid, homocysteic acid, Asp, and an alkylated derivative of Cys having the structure of

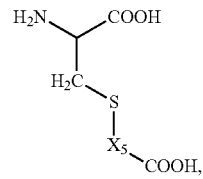

wherein $X_5$ is $C_1$-$C_4$ alkyl, $C_2$-$C_4$ alkenyl, or $C_2$-$C_4$ alkynyl.

In a specific embodiment, the Class 5 peptide may comprise the amino acid sequence of any of SEQ ID NOs: 1460-1470, 1473-1478, 1480-1488, 1490-1496, 1503, 1504, 1506, and 1514-1518, or comprising the amino acid sequence of any of Peptides 2-6 of Table 13, Peptides 1-8 of Table 14, and Peptides 2-6, 8, and 9 of Table 15.

TABLE 13

Lactam, Cex glucagon(6-39) peptides and glucagon antagonist and GLP-1 agonist activity

| | | | GLP-1 EC$_{50}$ (nM) | Glu IC$_{50}$ (nM) |
|---|---|---|---|---|
| 1 | E9, K12, E16 | FTSEYSKYLDERRAQDFVQWLMNTGPSSGAPPPS | 1451 | 762 |
| 2 | E9, K12E16(lactam) | FTSEYSKYLDERRAQDFVQWLMNTGPSSGAPPPS | 63 | 2008 |
| 3 | E9, E16K20(lactam) | FTSEYSKYLDERRAKDFVQWLMNTGPSSGAPPPS | 36 | 42 |
| 4 | D9, K12E16(Lactam) | FTSDYSKYLDERRAQDFVQWLMNTGPSSGAPPPS | 118.7 | 828 |
| 5 | [PLA6, E9, K12E16(Lactam) | PLA-TSEYSKYLDERRAQDFVQWLMNTGPSSGAPPPS | 6 | 72 |
| 6 | [PLA6, E9, E16K20(Lactam)] | PLA-TSEYSKYLDERRAKDFVQWLMNTGPSSGAPPPS | 20 | 20 |

TABLE 14

Lactam glucagon(1-29, 2-29, 4-29 and 6-29) peptides and their glucagon antagonist and GLP-1 agonist activity
(PA = partial antagonist)

|   | GLP-1 EC50 (nM) | Glucagon IC50 (nM) |
|---|---|---|
| Glucagon<br>HSQGTFTSDYSKYLDSRRAQDFVQWLMNT | | 0.2~1.0* |
| GLP-1 (aa 1-30)<br>HAEGTFTSDVSSYLEGQAAKEFIAWIVKGR | 0.02~0.1 | |
| 1 [PLA6, D9, E16K20(lactam), D28]G(6-29)<br>PLA TSDYSKYLDERRAKDFVQWLMDT | 5~25 | 10~30 |
| 2 [PLA6, D9, K12E16(Lactam), D28]G(6-29)<br>PLA TSDYSKYLDERRAQDFVQWLMDT | 177 | 63 |
| 3 [PLA6, D9, E16, K20E24(Lactam), D28]G(6-29)<br>PLA TSDYSKYLDERRAKDFVEWLMDT | 239 | 74 |
| 4 [PLA6, D9, E16, E24K28(lactam)]G(6-29)<br>PLA TSDYSKYLDERRAQDFVEWLMKT | 289 | 22 |
| 5 [E9, E16K20(lactam), D28]G(4~29)<br>GTFTSEYSKYLDERRAKDFVQWLMDT | 151 | 10~30 |
| 6 [E9, E16K20(lactam), D28]G(2~29)<br>SQGTFTSEYSKYLDERRAKDFVQWLMDT | 203 | 49 (PA) |
| 7 [A2E3, E16K20(Lactam), D28]G(2~29)<br>AEGTFTSEYSKYLDERRAKDFVQWLMDT | 175 | 63 |
| 8 [A2E3, E16K20(Lactam), D28]G(1~29)<br>HAEGTFTSEYSKYLDERRAKDFVQWLMDT | 0.2 | 130 (PA) |
| 9 ANK2 (Bayer peptide)<br>HSQGTFTSDY ARYLDARRAREFIKWL VRGRG | 0.28 | agonist |

*EC50 at glucagon receptor

TABLE 15

| Profile of Mixed Agonist/Antagonist | | | |
|---|---|---|---|
| Glucagon (6-CEX) Analogs | | | |
| 1 E9, K12, E16 | FTSEYSKYLDERRAQDFVQWLMNTGPSSGAPPPS | 1451 | 762 |
| 2 E9, K12E16(lactam) | FTSEYSKYLDERRAQDFVQWLMNTGPSSGAPPPS | 63 | 2008 |
| 3 E9, E16K20(lactam) | FTSEYSKYLDERRAKDFVQWLMNTGPSSGAPPPS | 36 | 42 |
| 4 D9, K12E20(lactam) | FTSDYSKYLDERRAQDFVQWLIMNTGPSSGAPPPS | 18 | 828 |
| 5 [PLA6, E9, K12E20(lactam) | PLA-TSEYSKYLDERRAQDFVQWLMNTGPSSGAPPPS | 6 | 72 |
| 6 [PLA6, E9, E16K20(Lactam)] | PLA-TSEYSKYLDERRAKDFVQWLMNTGPSSGAPPPS | 20 | 20 |
| Glucagon $D^9$(6-29) analogs | | | |
| | | GLP-1 EC50 (nM) | Glucagon IC50 (nM) |
| 7 PLA 6, D9, D28 | PLA-TSDYSKYLDSRRAQDFVQWLMDT | ~700 | tbd |
| 8 PLA6, D9, K12E20(Lactam) | PLA-TSDYSKYLDERRAQDFVQWLMDT | 21 | 13 |
| 9 PLA6, D9, E16K20(lactam) | PLA-TSDYSKYLDERRAKDFVQWLMDT | 4 | 6 |

In some embodiments, the peptide comprising the general structure A-B-C is a Class 5 peptide. In a specific embodiment, the peptide exhibits at least about 50% of the maximum agonism achieved by native GLP-1 at the GLP-1 receptor and at least about 50% inhibition of the maximum response achieved by native glucagon at the glucagon receptor. In another specific embodiment, the peptide exhibits at least about 55%, at least about 60%, at least about 70%, at least about 80%, at least about 90%, at least about 95%, or about 100% of the maximum agonism achieved by native GLP-1 at the GLP-1 receptor. Alternatively or additionally, the peptide may exhibit at least about 55%, at least about 60%, at least about 70%, at least about 80%, at least about 90%, at least about 95%, or about 100% inhibition of the maximum response achieved by native glucagon at the glucagon receptor.

In some embodiments, a peptide with Class 5 peptide or conjugate thereof, is provided comprising:

(1) modifications that confer glucagon antagonist activity, including but not limited to:
  (a) substitution of the Phe at position 6 with PLA (according to amino acid numbering of wild type glucagon), optionally with deletion of 1 to 5 amino acids from the N-terminus of wild type glucagon; or
  (b) deletion of 2 to 5 amino acids from the N-terminus of wild type glucagon; optionally with substitution of Asp at position 9 of wild type glucagon with glutamic acid, homoglutamic acid or a sulfonic acid derivative of cysteine (according to amino acid numbering of wild type glucagon);

and (2) modifications that confer GLP-1 agonist activity, including but not limited to:
  (a) insertion or substitution of α,α-disubstituted amino acid within amino acids 12-29 of wild type glucagon, e.g. at one, two, three, four or more of positions 16, 17, 18, 19, 20, 21, 24 or 29 (according to the amino acid numbering of wild type glucagon); or
  (b) introduction of an intramolecular bridge within amino acids 12-29 of wild type glucagon, e.g. a salt bridge or a lactam bridge or another type of covalent bond; or
  (c) substitution of the amino acid at one or more of positions 2, 3, 17, 18, 21, 23, or 24 (according to the amino acid numbering of native glucagon) with the corresponding amino acid of GLP-1, e.g. Ser2 is replaced with Ala, Gln3 is replaced with Glu, Arg17 is replaced with Gln, Arg at position 18 is replaced with Ala, Asp at position 21 is replaced with Glu, Val at position 23 is replaced with Ile, and/or Gln at position 24 is replaced with Ala; or
  (d) other modifications that stabilize the alpha-helix structure around amino acid positions 12-29 according to the amino acid numbering of wild type glucagon;

and (3) other modifications that enhance GLP-1 agonist activity, e.g.
  (a) a C-terminal amide or ester in place of a C-terminal carboxylate;

and optionally (4) one or more of the following modifications:
  (a) covalent attachment to a hydrophilic moiety, such as polyethylene glycol, e.g. at the N-terminus, or at position 6, 16, 17, 20, 21, 24, 29, 40 or at the C-terminal amino acid; and/or
  (b) acylation or alkylation; and optionally (5) one or more of the following additional modifications:
  (a) covalent linkage of amino acids, to the N-terminus, e.g. 1-5 amino acids to the N-terminus, optionally via an ester bond to PLA at position 6 (according to the numbering of wild type glucagon), optionally together with modifications at position 1 or 2, e.g. as described herein, that improve resistance to DPP-IV cleavage;
  (b) deletion of amino acids at positions 29 and/or 28, and optionally position 27 (according to the numbering of wild type glucagon);
  (c) covalent linkage of amino acids to the C-terminus;
  (d) non-conservative substitutions, conservative substitutions, additions or deletions while retaining desired activity, for example, conservative substitutions at one or more of positions 2, 5, 7, 10, 11, 12, 13, 14, 16, 17, 18, 19, 20, 21, 24, 27, 28 or 29, substitution of Tyr at position 10 with Val or Phe, substitution of Lys at position 12 with Arg, substitution of one or more of these positions with Ala;
  (e) modification of the aspartic acid at position 15, for example, by substitution with glutamic acid, homoglutamic acid, cysteic acid or homocysteic acid, which may reduce degradation; or modification of the serine at position 16, for example, by substitution of threonine, AIB, glutamic acid or with another negatively charged amino acid having a side chain with a length of 4 atoms, or alternatively with any one of glutamine, homoglutamic acid, or homocysteic acid, which likewise may reduce degradation due to cleavage of the Asp15-Ser16 bond;
  (f) modification of the methionine at position 27, for example, by substitution with leucine or norleucine, to reduce oxidative degradation;
  (g) modification of the Gln at position 20 or 24, e.g. by substitution with Ala or AIB, to reduce degradation that occurs through deamidation of Gln
  (h) modification of Asp at position 21, e.g. by substitution with Glu, to reduce degradation that occurs through dehydration of Asp to form a cyclic succinimide intermediate followed by isomerization to isoaspartate;
  (j) homodimerization or heterodimerization as described herein; and
  (k) combinations of the above.

It is understood that any of the modifications within the same class may be combined together and/or modifications of different classes are combined. For example, the modifications of (1)(a) may be combined with (2)(a) and (3); (1)(a) may be combined with (2)(b), e.g. lactam bridge or salt bridge, and (3); (1)(a) may be combined with (2)(c) and (3); (1)(b) may be combined with (2)(a) and (3); (1)(b) may be combined with (2)(b), e.g. lactam bridge or salt bridge, and (3); (1)(b) may be combined with (2)(c) and (3); any of the foregoing may be combined with (4)(a) and/or (4)(b); and any of the foregoing may be combined with any of (5)(a) through (5)(k).

In exemplary embodiments, the α,α-disubstituted amino acid AIB is substituted at one, two, three or all of positions 16, 20, 21, or 24 (according to the amino acid numbering of wild type glucagon).

In exemplary embodiments, the intramolecular bridge is a salt bridge.

In other exemplary embodiments, the intramolecular bridge is a covalent bond, e.g. a lactam bridge. In some embodiments, the lactam bridge is between the amino acids at positions 9 and 12, the amino acids at positions 12 and 16, the amino acids at positions 16 and 20, the amino acids at positions 20 and 24, or the amino acids at positions 24 and 28 (according to the amino acid numbering of SEQ ID NO: 1401).

In exemplary embodiments, acylation or alkylation is at position 6, 10, 20 or 24 or the N-terminus or C-terminus (according to the amino acid numbering of wild type glucagon) SEQ ID NO: 1401).

In exemplary embodiments, modifications include:
(i) substitution of Asp at position 15 (according to the numbering of SEQ ID NO: 1401) with cysteic acid, glutamic acid, homoglutamic acid, and homocysteic acid;
(ii) substitution of Ser at position 16 (according to the numbering of SEQ ID NO: 1401) with cysteic acid, glutamic acid, homoglutamic acid, and homocysteic acid;
(iii) substitution of Asn at position 28 with a charged amino acid;
(iv) substitution of Asn at position 28 with a charged amino acid selected from the group consisting of Lys, Arg, His, Asp, Glu, cysteic acid, and homocysteic acid;
(v) substitution at position 28 with Asn, Asp, or Glu;
(vi) substitution at position 28 with Asp;
(vii) substitution at position 28 with Glu;
(viii) substitution of Thr at position 29 with a charged amino acid;
(ix) substitution of Thr at position 29 with a charged amino acid selected from the group consisting of Lys, Arg, His, Asp, Glu, cysteic acid, and homocysteic acid;
(x) substitution at position 29 with Asp, Glu, or Lys;
(xi) substitution at position 29 with Glu;
(xii) insertion of 1-3 charged amino acids after position 29;
(xiii) insertion after position 29 of Glu or Lys;
(xiv) insertion after position 29 of Gly-Lys or Lys-Lys;
or combinations thereof.

Any of the modifications described above which increase GLP-1 receptor agonist activity, glucagon receptor antagonist activity, peptide solubility, and/or peptide stability can be applied individually or in combination.

Modification to Enhance Stability

In accordance with some embodiments the Class 5 peptides disclosed herein can be further modified to include the amino acid sequence of SEQ ID NO: 1421 (GPSSGAPPPS), or SEQ ID NO: 1450, linked to the carboxy terminal amino acid (position 24) of the Class 5 peptide and administered to individuals to induce weight loss or assist in weight maintenance. More particularly, the Class 5 peptide comprises a sequence selected from the group consisting of SEQ ID NO: 1405, SEQ ID NO: 1406, SEQ ID NO: 1407, SEQ ID NO: 1408, SEQ ID NO: 1409, SEQ ID NO: 1412, SEQ ID NO: 1413, SEQ ID NO: 1414, SEQ ID NO: 1416, SEQ ID NO: 1417, SEQ ID NO: 1418, SEQ ID NO: 1419, SEQ ID NO: 1422, SEQ ID NO: 1423, SEQ ID NO: 1424 and SEQ ID NO: 1425 and further comprising the amino acid sequence of SEQ ID NO: 1421 (GPSSGAPPPS), or SEQ ID NO: 1450, linked to the carboxy terminal amino acid (position 24) of the peptide or Class 5 peptide, is used to suppress appetite and inducing weight loss/weight maintenance. In some embodiments the administered peptide or Class 5 peptide comprises a sequence selected from the group consisting of SEQ ID NO: 1416, SEQ ID NO: 1417, SEQ ID NO: 1418 and SEQ ID NO: 1419, further comprising the amino acid sequence of SEQ ID NO: 1421 (GPSSGAPPPS) linked to the carboxy terminal amino acid (position 24) of the Class 5 peptide. In some embodiments the method comprises administering a peptide or Class 5 peptide comprising the sequence of SEQ ID NO: 1445 or SEQ ID NO: 1446.

Accordingly, it is expected that the Class 5 peptides disclosed herein can be similarly modified to decrease their susceptibility to premature chemical cleavage in aqueous buffers. In accordance with some embodiments the Class 5 peptides described herein can be further modified to enhance their stability in aqueous solutions by replacing the native aspartic amino acid, located at corresponding position 15 of native glucagon, with an amino acid selected from the group consisting of cysteic acid, glutamic acid, homoglutamic acid and homocysteic acid. In accordance with some embodiments the aspartic acid residue at position 10 of class 5 peptide of SEQ ID NO: 1405, SEQ ID NO: 1406, SEQ ID NO: 1407 or SEQ ID NO: 1408 can be substituted with an amino acid selected from the group consisting of cysteic acid, glutamic acid, homoglutamic acid and homocysteic acid, and in some embodiments the native aspartic acid at position 10 of SEQ ID NO: 1405, SEQ ID NO: 1406, SEQ ID NO: 1407 or SEQ ID NO: 1408 is replaced with glutamic acid. In accordance with some embodiments a class 5 peptide having improved stability in aqueous solutions is provided wherein the antagonist comprises a modified sequence of SEQ ID NO: 1409, wherein the modification comprises substitution of the Asp at position 10 of SEQ ID NO: 1409 with Glu. In some embodiments a class 5 peptide is provided comprising a sequence selected form the group consisting of SEQ ID NO: 1422, SEQ ID NO: 1423, SEQ ID NO: 1424 and SEQ ID NO: 1425. In some embodiments the class 5 peptide is amidated.

The Asp-Ser sequence at position 15-16 of native glucagon has been identified as a uniquely unstable dipeptide that leads to premature chemical cleavage of the native hormone in aqueous buffers. For example, when maintained at 0.01N HCl at 37° C. for 2 weeks, more than 50% of the native glucagon may be cleaved into fragments. The two liberated cleavage peptides 1-15 and 16-29 are devoid of glucagon-like biological activity and thus represent a limitation on the aqueous pre-formulation of glucagon and its related analogs. The selective chemical substitution of the Asp at position 15 of native glucagon with Glu has been observed to virtually eliminate chemical cleavage of the 15-16 peptide bond.

In yet further exemplary embodiments, any of the foregoing compounds can be further modified to improve stability by modifying the amino acid corresponding to position 15 or 16 of native glucagon, to reduce degradation of the peptide over time, especially in acidic or alkaline buffers.

Modification to Enhance Solubility

The class 5 peptide can be further modified to improve the peptide's solubility in aqueous solutions at physiological pH, in certain aspects, while retaining the glucagon antagonist and GLP-1 agonist activity. Introduction of hydrophilic groups at positions corresponding to positions 12, 15, 16, 19 and 24 of the peptide of SEQ ID NO: 1405, or at positions 12, 16, 19 or 24 of the peptide of SEQ ID NO: 1406 can improve the solubility of the resulting peptides in solutions having a physiological pH, while retaining the parent compounds glucagon antagonist and GLP agonist activity. Therefore, in some embodiments the presently disclosed class 5 peptide that are further modified to comprise one or more hydrophilic groups covalently linked to the side chains of amino acids corresponding to amino acid positions 12, 15, 16, 19 and 24 of the peptide of SEQ ID NO: 1405 or SEQ ID NO: 1406. In a further embodiment the side chains of amino acids corresponding to amino acid positions 16 and 19 of SEQ ID NO: 1405 or SEQ ID NO: 1406 are covalently bound to hydrophilic groups, and in some embodiments the hydrophilic group is polyethylene glycol (PEG).

Class 5 glucagon related peptides can be modified by introducing charge at its carboxy terminus to enhance the solubility of the peptide while retaining the agonist properties of the peptide. The enhanced solubility allows for the preparation and storage of glucagon solutions at near neutral pH. Formulating glucagon solutions at relatively neutral pHs (e.g. pH of about 6.0 to about 8.0) improves the long term stability of the Class 5 peptides.

Applicants anticipate that class 5 peptides disclosed herein can be similarly modified to enhance their solubility in aqueous solutions at relatively neutral pH (e.g. pH of about 6.0 to about 8.0), in some cases, while retaining a glucagon antagonist and GLP-1 activity. Accordingly, some embodiments is directed to a glucagon antagonist/GLP-1 of SEQ ID NO: 1405, SEQ ID NO: 1406, SEQ ID NO: 1407 or SEQ ID NO: 1408 that has been further modified relative to the native amino acids present at positions 6-29 of the wild type glucagon (SEQ ID NO: 1401) to add charge to the peptide by the substitution of native non-charged amino acids with charged amino acids, or the addition of charged amino acids to the carboxy terminus. In accordance with some embodiments, one to three of the non-charged native amino acids of the class 5 peptides disclosed herein are replaced with a charged amino acid. In some embodiments the charged amino acid is selected from the group consisting of lysine, arginine, histidine, aspartic acid and glutamic acid. More particularly, applicants have discovered that substituting the normally occurring amino acid corresponding to position 28 and/or 29 (relative to native glucagon) with charged amino acids, and/or the addition of one to two charged amino acids at the carboxy terminus of the peptide, enhances the solubility and stability of the Class 5 peptide in aqueous solutions at physiologically relevant pHs (i.e., a pH of about 6.5 to about 7.5). Accordingly such modifications of class 5 peptides are anticipated to have a similar effect on the solubility in aqueous solutions, particularly at a pH ranging from about 5.5 to about 8.0, while retaining the parent peptide's biological activity In accordance with some embodiments the class 5 peptide of SEQ ID NO: 1405, SEQ ID NO: 1406, SEQ ID NO: 1407 or SEQ ID NO: 1408 is modified by the substitution of the native amino acid at position 23 and/or 24 of those sequences with a negatively charged amino acid (e.g., aspartic acid or glutamic acid) and optionally the addition of a negatively charged amino acid (e.g., aspartic acid or glutamic acid) to the carboxy terminus of the peptide. In an alternative embodiment a class 5 peptide comprising SEQ ID NO: 1405, SEQ ID NO: 1406, SEQ ID NO: 1407 or SEQ ID NO: 1408 is modified by the substitution of the native amino acid at position 24 of SEQ ID NO: 1405, SEQ ID NO: 1406, SEQ ID NO: 1407 or SEQ ID NO: 1408 with a positively charged amino acid (e.g., lysine, arginine or histidine) and optionally the addition of one or two positively charged amino acid (e.g., lysine, arginine or histidine) on the carboxy terminus of the peptide. In accordance with some embodiments a class 5 peptide having improved solubility and stability is provided wherein the analog comprises the amino acid sequence of SEQ ID NO: 1415 or SEQ ID NO: 1451 with the proviso that at least one amino acids at position, 23, or 24 of SEQ ID NO: 1415 or SEQ ID NO: 1451 is substituted with an acidic amino acid and/or an additional acidic amino acid added at the carboxy terminus of SEQ ID NO: 1415 or SEQ ID NO: 1451. In some embodiments the acidic amino acids are independently selected from the group consisting of Asp, Glu, cysteic acid and homocysteic acid.

In accordance with some embodiments a class 5 peptide having improved solubility and stability is provided wherein the antagonist comprises the amino acid sequence of SEQ ID NO: 1416, SEQ ID NO: 1417, SEQ ID NO: 1418 or SEQ ID NO: 1419. In accordance with some embodiments a glucagon agonist is provided comprising the sequence of SEQ ID NO: 1416 or SEQ ID NO: 1417. In some embodiments the class 5 peptide comprises the sequence of SEQ ID NO: 1420.

In accordance with some embodiments a class 5 peptide is provided comprising the sequence of SEQ ID NO: 1415 or SEQ ID NO: 1451. In some embodiments, position 4 of SEQ ID NO: 1415 or SEQ ID NO: 1451 is aspartic acid, glutamic acid, homoglutamic acid, cysteic acid or homocysteic acid, and in some embodiments position 4 is aspartic acid, glutamic acid, cysteic acid or homocysteic acid, and in a further embodiment position 4 of SEQ ID NO: 1415 or SEQ ID NO: 1451 is aspartic acid or glutamic acid, and in some embodiments position 4 of SEQ ID NO: 1415 or SEQ ID NO: 1451 is aspartic acid. In some embodiments a class 5 peptide is provided comprising the sequence of SEQ ID NO: 1415 or SEQ ID NO: 1451 wherein position 4 of SEQ ID NO: 1415 is aspartic acid and position 10 of SEQ ID NO: 1415 is glutamic acid. In a further embodiment the C-terminal amino acid of SEQ ID NO: 1415 or SEQ ID NO: 1451 is modified to replace the native carboxylic acid group with a charge-neutral group, such as an amide or ester.

Class 5 Peptide Fusions

In a further embodiment, the carboxy terminal amino acid of the Class 5 peptide described herein is covalently bound to a second peptide comprising a sequence selected from the group consisting of SEQ ID NOs: 1421, 1426, 1427, and 1450. For example, in some embodiments, the Class 5 peptide of SEQ ID NO: 1415, SEQ ID NO: 1451, SEQ ID NO: 1405, SEQ ID NO: 1406, SEQ ID NO: 1407, SEQ ID NO: 1408, SEQ ID NO: 1412, SEQ ID NO: 1413, SEQ ID NO: 1414, SEQ ID NO: 1416, SEQ ID NO: 1417, SEQ ID NO: 1418, SEQ ID NO: 1419, SEQ ID NO: 1422, SEQ ID NO: 1423, SEQ ID NO: 1424 and SEQ ID NO: 1425 is covalently bound to a second peptide comprising a sequence selected from the group consisting of SEQ ID NO: 1421 (GPSSGAPPPS), SEQ ID NO: 1426 (KRNRNNIA), SEQ ID NO: 1427 (KRNR) and SEQ ID NO: 1450 (GPSSGAPPPSX).

In some embodiments a class 5 peptide dimer is provided comprising two sequences independently selected from the group consisting of SEQ ID NO: 1405, SEQ ID NO: 1406, SEQ ID NO: 1407, SEQ ID NO: 1408, SEQ ID NO: 1409, SEQ ID NO: 1422, SEQ ID NO: 1423, SEQ ID NO: 1424 and SEQ ID NO: 1425 that further comprises an amino acid sequence of SEQ ID NO: 1421 (GPSSGAPPPS) linked to the carboxy terminal amino acid of the class 5 peptide.

In some embodiments, the class 5 peptide is further modified by truncation or deletion of one or two amino acids of the C-terminus of the peptide (i.e., truncation of the amino acid at position 29 or at positions 28 and 29 of native glucagon). Preferably truncation does not effect activity (e.g., glucagon antagonism/GLP-1 agonism) of a class 5 peptide.

Class 5 Peptide Conjugates

Conjugates of Class 5 peptides are also provided, in which the glucagon peptide is linked, optionally via covalent bonding and optionally via a linker, to a conjugate moiety.

In those embodiments wherein the class 5 peptide comprises a polyethylene glycol chain, the polyethylene glycol chain may be in the form of a straight chain or it may be branched. In accordance with some embodiments the polyethylene glycol chain has an average molecular weight selected from the range of about 500 to about 10,000 Daltons. In some embodiments the polyethylene glycol chain has an average molecular weight selected from the range of about 1,000 to about 5,000 Daltons. In some embodiments the polyethylene glycol chain has an average molecular weight selected from the range of about 1,000 to about 5,000 Daltons. In some embodiments the polyethylene glycol chain has an average molecular weight selected of about 1,000 to about 2,000 Daltons. In some embodiments the polyethylene glycol chain has an average molecular weight of about 1,000 Daltons.

In some embodiments the pegylated clas 5 peptide comprises a peptide consisting of the sequence of SEQ ID NO:

1415 or SEQ ID NO: 1451 wherein the polyethylene glycol chain is linked to an amino acid selected from positions 11, 12, 15, 16, 19 and 24 of SEQ ID NO: 1415 or SEQ ID NO: 1451, and the molecular weight of the PEG chain is about 1,000 to about 5,000 Daltons. In some embodiments the pegylated class 5 peptide comprises a peptide consisting of the sequence of SEQ ID NO: 1415 or SEQ ID NO: 1451 wherein the polyethylene glycol chain is linked to the amino acid at position 16 or 19 of SEQ ID NO: 1415 or SEQ ID NO: 1451, and the molecular weight of the PEG chain is about 1,000 to about 5,000 Daltons. In a further embodiment the modified class 5 peptide comprises two or more polyethylene glycol chains covalently bound to the peptide wherein the total molecular weight of the glucagon chains is about 1,000 to about 5,000 Daltons. In some embodiments the class peptide comprises the sequence of SEQ ID NO: 1415 or SEQ ID NO: 1451 wherein a polyethylene glycol chain is linked to the amino acid at positions 16 and 19 of SEQ ID NO: 1415 or SEQ ID NO: 1451 and the combined molecular weight of the two PEG chains is about 1,000 to about 5,000 Daltons.

The class 5 glucagon related peptide may comprise the amino acid sequence of any of SEQ ID NOs: 1401-1518, optionally with up to 1, 2, 3, 4, or 5 further modifications that retain glucagon antagonist and GLP-1 agonist activity.

Effect of Dipeptide Prodrug Element Structure on Cleavage Rate

As previously described herein, the rate of cleavage of the dipeptide prodrug element A-B from the glucagon superfamily peptide, and thus activation of the prodrug, depends on the structure (including N-alkylation, number of substituents, length or bulkiness), and stereochemistry of the amino acids of the dipeptide prodrug element. The rate of cleavage of the dipeptide prodrug element A-B from the glucagon superfamily peptide also depends on the steric hindrance, nucleophilicity, stability of the leaving group of Q during diketopiperazine formation. Some of these structural features are described in Category I, Category II, and Category III below, which form part of the invention. Explicitly excluded from any of these categories are peptide sequences disclosed in Int'l Application No. PCT/US2009/68745, filed Dec. 18, 2009 or its sequence listing, and sub-categories of (1) dipeptide prodrug elements, (2) A amino acids, and/or (3) B amino acids disclosed in Int'l Application No. PCT/US2009/68745, filed Dec. 18, 2009, to the extent they fall completely within and/or overlap with a portion of any of the sub-categories described herein, and only to the extent necessary to confer novelty on claimed subject matter.

Category I: Composition of Amino Acid B of the Dipeptide Prodrug Element

In some embodiments, the half-life of the prodrug, e.g., the chemical cleavage half-life ($t_{1/2}$) of A-B from Q of at least about 1 hour to about 1 week in PBS, under physiological conditions, is dependent on the presence and length of the N-alkyl substituent on the B amino acid. For example, a prodrug that has a shorter N-alkyl substituent on the B amino acid (e.g. Gly(N-methyl)), will undergo a slower rate of cleavage of A-B, and have a longer half-life, than a prodrug that has a longer N-alkyl substituent on the B amino acid (e.g., Gly(N-hexyl)).

In some embodiments, the half-life of the prodrug is dependent on the degree of substitution at the beta position of the B amino acid of the dipeptide prodrug element. For example, a prodrug that has a B amino acid that is disubstituted at the beta position (e.g., N-alkylated isoleucine) will undergo slower cleavage of A-B, and have a longer half-life, than a prodrug that has a B amino acid that is monosubstituted at the beta position (e.g., N-alkylated leucine). Further, a prodrug that has a B amino acid that is monosubstituted at the beta position (e.g., N-alkylated leucine) will undergo slower cleavage of A-B, and have a longer half-life, than a prodrug that has a B amino acid that is unsubstituted at the beta position (e.g., N-alkylated alanine). Further still, a prodrug that has a B amino acid that has carbon at the beta position (e.g., N-alkylated alanine) will undergo slower cleavage of A-B, and have a longer half-life, than a prodrug that has glycine as the B amino acid.

In some embodiments, the half-life of the prodrug is dependent on the bulkiness of the side chain of the B amino acid. For example, a prodrug that has a bulkier side chain on the B amino acid (e.g., N-alkylated phenylalanine), will undergo slower cleavage of A-B, and have a longer half-life, than a prodrug that has a less bulky side chain on the B amino acid (e.g., N-alkylated alanine).

The composition of the B amino acid of the dipeptide prodrug element can be classified into the below sub-categories IA, IB, and IC. Generally, the dipeptide prodrug elements in sub-category IA undergo cleavage the fastest and the dipeptide prodrug elements in sub-category IC undergo cleavage the slowest.

Sub-Category IA. Amino Acid B of the Dipeptide Prodrug Element is N-Alkylated Glycine In some embodiments, the prodrug comprises the structure:

A-B-Q;

wherein Q is a glucagon superfamily peptide;
wherein A-B comprises the structure:

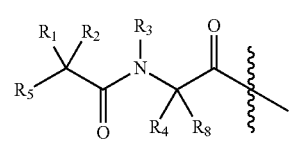

I wherein
$R_1$ and $R_2$ are independently selected from the group consisting of H, $C_1$-$C_{18}$ alkyl, $C_2$-$C_{18}$ alkenyl, ($C_1$-$C_{18}$ alkyl)OH, ($C_1$-$C_{18}$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2^+$)NH$_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl)R$_7$, ($C_1$-$C_4$ alkyl)($C_3$-$C_9$ heteroaryl), and $C_1$-$C_{12}$ alkyl(W$_1$)$C_1$-$C_{12}$ alkyl, wherein W$_1$ is a heteroatom selected from the group consisting of N, S and O, or $R_1$ and $R_2$ together with the atoms to which they are attached form a $C_3$-$C_{12}$ cycloalkyl;
$R_3$ is $C_1$-$C_{18}$ alkyl;
$R_4$ and $R_8$ are each H;
$R_5$ is NHR$_6$;
$R_6$ is H or $C_1$-$C_4$ alkyl, or $R_5$ and $R_2$ together with the atoms to which they are attached form a 4, 5 or 6 member heterocyclic ring; and,
$R_7$ is selected from the group consisting of H, OH, halo, ($C_1$-$C_7$ alkyl), ($C_2$-$C_7$ alkenyl), OCF$_3$, NO$_2$, CN, NC, O($C_1$-$C_7$ alkyl), CO$_2$H, CO$_2$($C_1$-$C_7$ alkyl), NHR$_6$, aryl, and heteroaryl.

In some embodiments, the B amino acid is selected from the group consisting of glycine(N-methyl), glycine(N-ethyl), glycine(N-propyl), glycine(N-butyl), glycine(N-pentyl), glycine(N-hexyl), glycine(N-heptyl), and glycine(N-octyl). For example, the B amino acid can be glycine(N-methyl) or glycine(N-hexyl).

In some embodiments when $R_1$ and $R_2$ are both hydrogen, $R_3$ is $C_1$-$C_4$ alkyl, for example, when A-B is conjugated to an aliphatic amine. In some embodiments when $R_1$ and $R_2$ are both hydrogen, $R_3$ is $C_5$-$C_8$ alkyl, for example, when A-B is conjugated to an aliphatic amine. In some embodiments when at least one of $R_1$ or $R_2$ is not hydrogen, $R_3$ is $C_1$-$C_4$ alkyl, for example, when A-B is conjugated to an aliphatic amine. In some embodiments when at least one of $R_1$ or $R_2$ is not hydrogen, $R_3$ is $C_5$-$C_8$ alkyl, for example, when A-B is conjugated to an aliphatic amine.

In some embodiments when $R_1$ and $R_2$ are both hydrogen and $R_3$ is methyl, A-B is not conjugated to the alpha amino group of $F^7$GLP-1(8-37).

Sub-Category IB. Amino Acid B of the Dipeptide Prodrug Element is Unsubstituted or Monosubstituted at the Beta Position In some embodiments, the prodrug comprises the structure:

A-B-Q;

wherein Q is a glucagon superfamily peptide;
wherein A-B comprises the structure:

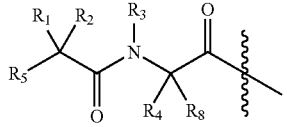

wherein $R_1$ and $R_2$ are independently selected from the group consisting of H, $C_1$-$C_{18}$ alkyl, $C_2$-$C_{18}$ alkenyl, ($C_1$-$C_{18}$ alkyl)OH, ($C_1$-$C_{18}$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2^+$)NH$_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl)$R_7$, ($C_1$-$C_4$ alkyl)($C_3$-$C_9$ heteroaryl), and $C_1$-$C_{12}$ alkyl($W_1$)$C_1$-$C_{12}$ alkyl, wherein $W_1$ is a heteroatom selected from the group consisting of N, S and O, or $R_1$ and $R_2$ together with the atoms to which they are attached form a $C_3$-$C_{12}$ cycloalkyl;

$R_3$ is $C_1$-$C_{18}$ alkyl;

$R_4$ is selected from the group consisting of CH$_3$, CH$_2$($C_1$-$C_{10}$ alkyl), CH$_2$($C_2$-$C_{10}$ alkenyl), CH$_2$($C_0$-$C_{10}$ alkyl)OH, CH$_2$($C_0$-$C_{10}$ alkyl)SH, CH$_2$($C_0$-$C_3$ alkyl)SCH$_3$, CH$_2$($C_0$-$C_3$ alkyl)CONH$_2$, CH$_2$($C_0$-$C_3$ alkyl)COOH, CH$_2$($C_0$-$C_3$ alkyl)NH$_2$, CH$_2$($C_0$-$C_3$ alkyl)NHC(NH$_2^+$)NH$_2$, CH$_2$($C_0$-$C_3$ alkyl)($C_3$-$C_6$ cycloalkyl), CH$_2$($C_0$-$C_3$ alkyl)($C_2$-$C_5$ heterocyclic), CH$_2$($C_0$-$C_3$ alkyl)($C_6$-$C_{10}$ aryl)$R_7$, CH$_2$($C_1$-$C_3$ alkyl)($C_3$-$C_9$ heteroaryl), and CH$_2$($C_0$-$C_{12}$ alkyl)($W_1$)$C_1$-$C_{12}$ alkyl, wherein $W_1$ is a heteroatom selected from the group consisting of N, S and O; or $R_4$ and $R_3$ together with the atoms to which they are attached form a 4, 5 or 6 member heterocyclic ring;

$R_8$ is H, $R_5$ is NHR$_6$, or $R_5$ and $R_2$ together with the atoms to which they are attached form a 4, or 6 member heterocyclic ring;

$R_6$ is H or $C_1$-$C_4$ alkyl; and, $R_7$ is selected from the group consisting of H, OH, halo, ($C_1$-$C_7$ alkyl), ($C_2$-$C_7$ alkenyl), OCF$_3$, NO$_2$, CN, NC, O($C_1$-$C_7$ alkyl), CO$_2$H, CO$_2$($C_1$-$C_7$ alkyl), NHR$_6$, aryl, and heteroaryl.

In some embodiments, $R_4$ is selected from the group consisting of CH$_3$, CH$_2$($C_1$-$C_4$ alkyl), CH$_2$($C_1$-$C_4$)alkenyl, CH$_2$($C_0$-$C_4$ alkyl)OH, CH$_2$($C_0$-$C_4$ alkyl)SH, CH$_2$($C_0$-$C_3$ alkyl)SCH$_3$, CH$_2$($C_0$-$C_3$ alkyl)CONH$_2$, CH$_2$($C_0$-$C_3$ alkyl)COOH, CH$_2$($C_0$-$C_4$ alkyl)NH$_2$, and CH$_2$($C_0$-$C_3$ alkyl)NHC(NH$_2^+$)NH$_2$.

Nonlimiting examples of the B amino acid in these embodiments include alanine(N—$C_1$-$C_{10}$alkyl), leucine (N—$C_1$-$C_{10}$alkyl), methionine(N—$C_1$-$C_{10}$alkyl), asparagine (N—$C_1$-$C_{10}$alkyl), glutamic acid(N—$C_1$-$C_{10}$alkyl), aspartic acid(N—$C_1$-$C_{10}$alkyl), glutamine(N—$C_1$-$C_{10}$alkyl), histidine(N—$C_1$-$C_{10}$alkyl), lysine(N—$C_1$-$C_{10}$alkyl), arginine (N—$C_1$-$C_{10}$alkyl), serine(N—$C_1$-$C_{10}$alkyl), and cysteine (N—$C_1$-$C_{10}$alkyl).

In some embodiments, the B amino acid is selected from the group consisting of alanine(N—$C_1$-$C_6$alkyl), leucine (N—$C_1$-$C_6$alkyl), methionine(N—$C_1$-$C_6$alkyl), asparagine (N—$C_1$-$C_6$alkyl), glutamic acid(N—$C_1$-$C_6$alkyl), aspartic acid(N—$C_1$-$C_6$alkyl), glutamine(N—$C_1$-$C_6$alkyl), histidine (N—$C_1$-$C_6$alkyl), lysine(N—$C_1$-$C_6$alkyl), arginine(N—$C_1$-$C_6$alkyl), serine(N—$C_1$-$C_6$alkyl), and cysteine(N—$C_1$-$C_6$alkyl).

For example, the B amino acid can include alanine(N-methyl), leucine(N-methyl), methionine(N-methyl), asparagine(N-methyl), glutamic acid(N-methyl), aspartic acid(N-methyl), glutamine(N-methyl), histidine(N-methyl), lysine (N-methyl), arginine(N-methyl), serine(N-methyl), and cysteine(N-methyl).

In some embodiments, $R_4$ is selected from the group consisting of CH$_2$($C_0$-$C_3$ alkyl)($C_3$-$C_6$ cycloalkyl), CH$_2$($C_0$-$C_3$ alkyl)($C_2$-$C_5$ heterocyclic), CH$_2$($C_0$-$C_3$ alkyl)($C_6$-$C_{10}$ aryl)$R_7$, CH$_2$($C_1$-$C_3$ alkyl)($C_3$-$C_9$ heteroaryl), and CH$_2$($C_0$-$C_{12}$ alkyl)($W_1$)$C_1$-$C_{12}$ alkyl, wherein $W_1$ is a heteroatom selected from the group consisting of N, S and O, and wherein $R_7$ is selected from the group consisting of H and OH.

Nonlimiting examples of the B amino acid in these embodiments include phenylalanine(N—$C_1$-$C_{10}$alkyl), tyrosine(N—$C_1$-$C_{10}$alkyl), and tryptophan(N—$C_1$-$C_{10}$alkyl). In some embodiments, the B amino acid is selected from the group consisting of phenylalanine(N—$C_1$-$C_6$alkyl), tyrosine(N—$C_1$-$C_6$alkyl), and tryptophan(N—$C_1$-$C_6$alkyl). For example, the B amino acid can include phenylalanine(N-methyl), tyrosine(N-methyl), and tryptophan(N-methyl).

In some embodiments, the B amino acid is proline. In some embodiments, proline is excluded from Sub-Category IB.

Sub-Category IC. Amino Acid B of the Dipeptide Prodrug Element Disubstituted at the Beta Position In some embodiments, the prodrug comprises the structure:

A-B-Q;

wherein Q is a glucagon superfamily peptide;
wherein A-B comprises the structure:

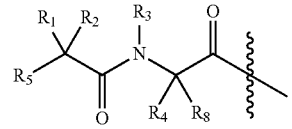

wherein $R_1$ and $R_2$ are independently selected from the group consisting of H, $C_1$-$C_{18}$ alkyl, $C_2$-$C_{18}$ alkenyl, ($C_1$-$C_{18}$ alkyl)OH, ($C_1$-$C_{18}$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2^+$)NH$_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl)$R_7$, ($C_1$-$C_4$ alkyl)($C_3$-$C_9$ heteroaryl), and $C_1$-$C_{12}$ alkyl($W_1$)$C_1$-$C_{12}$ alkyl, wherein $W_1$ is a heteroatom selected from the group consisting of N, S and O, or $R_1$ and $R_2$ together with the atoms to which they are attached form a $C_3$-$C_{12}$ cycloalkyl; or $R_1$ and $R_2$ together with the atoms to which they are attached form a $C_3$-$C_{12}$ cycloalkyl;

$R_3$ is $C_1$-$C_{18}$ alkyl;

$R_4$ is independently selected from the group consisting of $CH(C_1$-$C_8$ alkyl$)_2$, $CH(C_2$-$C_8$ alkenyl$)_2$, $CH(C_1$-$C_8$ alkyl)(OH), $CH(C_1$-$C_8$ alkyl)(($C_1$-$C_8$ alkyl)SH), $CH(C_1$-$C_3$ alkyl)(($C_1$-$C_8$ alkyl)($NH_2$));

$R_8$ is H;

$R_5$ is $NHR_6$, or $R_5$ and $R_2$ together with the atoms to which they are attached form a 4, 5 or 6 member heterocyclic ring;

$R_6$ is H or $C_1$-$C_4$ alkyl; and, $R_7$ is selected from the group consisting of H, OH, halo, ($C_1$-$C_7$ alkyl), ($C_2$-$C_7$ alkenyl), $OCF_3$, $NO_2$, CN, NC, $O(C_1$-$C_7$ alkyl), $CO_2H$, $CO_2(C_1$-$C_7$ alkyl), $NHR_6$, aryl, and heteroaryl.

In some embodiments, $R_4$ is $CH(C_1$-$C_8$ alkyl$)_2$ or $CH(C_1$-$C_8$ alkyl)OH. Nonlimiting examples of the B amino acid include isoleucine(N—$C_1$-$C_{10}$alkyl), valine(N—$C_1$-$C_{10}$alkyl), and threonine(N—$C_1$-$C_{10}$alkyl). In some embodiments, the B amino acid is selected from the group consisting of isoleucine(N—$C_1$-$C_6$alkyl), valine(N—$C_1$-$C_6$alkyl), and threonine(N—$C_1$-$C_6$alkyl). For example, the B amino acid can include isoleucine(N-methyl), valine(N-methyl), and threonine(N-methyl).

Category II. Composition of Amino Acid A of the Dipeptide Prodrug Element

In some embodiments, the half-life of the prodrug is dependent on the number of substituents at the alpha position of the A amino acid. For example, a prodrug comprising an A amino acid that is an α-monosubstituted amino acid (e.g., Ala) will undergo cleavage more slowly, and have a longer half-life than, a prodrug comprising an A amino acid that is an α,α-disubstituted amino acid (e.g., Aib).

In some embodiments, the half-life of the prodrug is dependent on the degree of alkylation on the alpha amino group of the A amino acid. Generally, the greater the degree of alkylation, the slower the rate of cleavage and the longer the half-life of the prodrug. For example, a dipeptide prodrug element having N-alkylated Ala will cleave at a slower rate, and have a longer half-life, than Ala.

The composition of the A amino acid of the dipeptide prodrug element can be classified into the below sub-categories IIA and IIB. Generally, the dipeptide prodrug elements in sub-category IIA cleave faster than dipeptide prodrug elements in sub-category IIB.

Sub-Category IIA: Amino Acid A of the Dipeptide Prodrug Element is Disubstituted at the Alpha Position In some embodiments, the A amino acid of the dipeptide prodrug element is disubstituted at the alpha position. In these embodiments, $R_1$ and $R_2$ of the structures described in sub-categories IA, IB, and IC are independently selected from the group consisting of $C_1$-$C_{10}$ alkyl, $C_2$-$C_{10}$ alkenyl, ($C_1$-$C_{10}$ alkyl)OH, ($C_1$-$C_{10}$ alkyl)SH, ($C_2$-$C_3$ alkyl)$SCH_3$, ($C_1$-$C_4$ alkyl)$CONH_2$, ($C_1$-$C_4$ alkyl)COOH, ($C_1$-$C_4$ alkyl)$NH_2$, ($C_1$-$C_4$ alkyl)NHC($NH_2^+$)$NH_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl)$R_7$, ($C_1$-$C_4$ alkyl)($C_3$-$C_9$ heteroaryl), and $C_1$-$C_{12}$ alkyl($W_1$)$C_1$-$C_{12}$ alkyl, wherein $W_1$ is a heteroatom selected from the group consisting of N, S and O, or $R_1$ and $R_2$ together with the atoms to which they are attached form a $C_3$-$C_{12}$ cycloalkyl, and wherein $R_7$ is selected from the group consisting of H and OH.

For example, the A amino acid can include aminoisobutyric acid (Aib).

Sub-Category IIB: Amino Acid A of the Dipeptide Prodrug Element is Unsubstituted or Monosubstituted at the Alpha Position In some embodiments, the A amino acid of the dipeptide prodrug element is unsubstituted or monosubstituted at the alpha position. In these embodiments, $R_1$ of the structures described in sub-categories IA, IB, and IC is H, and $R_2$ of the structures described in sub-categories IA, IB, and IC is selected from the group consisting of H, $C_1$-$C_{10}$ alkyl, $C_2$-$C_{10}$ alkenyl, ($C_1$-$C_{10}$ alkyl)OH, ($C_1$-$C_{10}$ alkyl)SH, ($C_2$-$C_3$ alkyl)$SCH_3$, ($C_1$-$C_4$ alkyl)$CONH_2$, ($C_1$-$C_4$ alkyl)COOH, ($C_1$-$C_4$ alkyl)$NH_2$, ($C_1$-$C_4$ alkyl)NHC($NH_2^+$)$NH_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl)$R_7$, ($C_1$-$C_4$ alkyl)($C_3$-$C_9$ heteroaryl), and $C_1$-$C_{12}$ alkyl($W_1$)$C_1$-$C_{12}$ alkyl, wherein $R_7$ is selected from the group consisting of H and OH, wherein $W_1$ is a heteroatom selected from the group consisting of N, S and O, or $R_1$ and $R_2$ together with the atoms to which they are attached form a $C_3$-$C_{12}$ cycloalkyl, or $R_2$ and $R_5$ together with the atoms to which they are attached form a 4, 5 or 6 member heterocyclic ring.

In some embodiments, the A amino acid of the dipeptide prodrug element has 'd' stereochemistry. Nonlimiting examples of the A amino acid in these embodiments include lysine, cysteine, and alanine. For example, d-lysine, d-cysteine, and d-alanine. In some embodiments, d-stereochemistry may enhance half-life through reducing proteolytic degradation of the prodrug peptide.

In some embodiments, the A amino acid is N-alkylated with a group that has 1 to 4 carbon atoms such as Ala(N—$C_1$-$C_4$alkyl), Lys(N—$C_1$-$C_4$alkyl), and Cys(N—$C_1$-$C_4$alkyl). For example, the A amino acid can be Ala(N-methyl), Lys(N-methyl), and Cys(N-methyl). N-alkylation of the A amino acid decreases the rate of cleavage of the dipeptide prodrug element from Q and provides a longer half-life.

Category III: Conjugation Site of the Dipeptide Prodrug Element (A-B) to the Glucagon Superfamily Peptide (Q)

In some embodiments, the half-life of the prodrug depends on the steric hindrance, nucleophilicity, and stability of the leaving group on Q during diketopiperazine formation. The less sterically hindered the leaving group, the less nucleophilic the leaving group, or the more stable the leaving group after cleavage, the shorter the half life of the prodrug. The type of leaving group on Q can be determined by the type of the linkage between A-B and an amino group of Q, as described in sub-categories IIIA and IIIB below. Generally, dipeptide prodrug elements in sub-category IIIA cleave slower from Q and have a longer half-life than dipeptide prodrug elements in subcategory IIIB.

Sub-Category IIIA: A-B Linked to an Aliphatic Amino Group of Q

In some embodiments, A-B is linked to Q through an amide bond between A-B and an aliphatic amino group of Q to result in a prodrug with a chemical cleavage half-life ($t_{1/2}$) of A-B from Q of at least about 1 hour to about 1 week in PBS, under physiological conditions, as previously described herein.

In some embodiments, A-B is linked to Q through an amide bond between A-B and the alpha amino group of the N-terminal amino acid of Q. For example, a dipeptide prodrug element having a B amino acid from any of sub-categories IA, IB, and IC and an A amino acid from any of sub-categories IIA and IIB can be linked to the N-terminal amino acid of Q to result in a prodrug with a chemical cleavage half-life ($t_{1/2}$) of A-B from Q of at least about 1 hour to about 1 week in PBS, under physiological conditions.

In some embodiments, A-B is linked to Q through an amide bond between A-B and an aliphatic amino group on a side chain of an amino acid of Q. For example, a dipeptide prodrug element having a B amino acid from any of sub-categories IA, IB, and IC and an A amino acid from any of sub-categories IIA and IIB can be linked to an aliphatic amino group of a side chain of an amino acid of Q to result in a prodrug with a chemical cleavage half-life ($t_{1/2}$) of A-B from Q of at least about 1 hour to about 1 week in PBS, under physiological conditions.

In some embodiments, when A-B is linked to Q through an amide bond between A-B and an aliphatic amino group of Q, either A should be an α,α-disubstituted amino acid (Sub-category IIA) or B should be N-alkylated (any of Sub-categories IA, IB or IC), or both. For example, when A is an α-mono-substituted amino acid (e.g., Ala), B is not N-alkylated, and A-B is attached to Q through an aliphatic amino group of Q, then there will not be significant cleavage of A-B.

In other embodiments, when A-B is linked to the alpha amino group of $F^7$GLP-1(8-37), A-B is not Gly-Gly(N-Me).

In other optional embodiments, when A-B is linked to Q through an amide bond between A-B and an aliphatic amino group of Q, and A is an amino acid that is unsubstituted at the alpha position (e.g. glycine) and B is an amino acid from Sub-category IA (N-alkylated glycine), the N-alkyl substitutent of the B amino acid has a length of at least five carbon atoms (for example, N—$C_5$-$C_8$alkyl).

In yet other embodiments, when A-B is linked to Q through an amide bond between A-B and an aliphatic amino group of Q, and the A amino acid is unsubstituted or monosubstituted at the alpha position (Sub-category IIB), the B amino acid is not proline. In some embodiments, when A-B is linked to Q through an amide bond between A-B and an aliphatic amino group of Q, A-B is not Gly-Pro. In some embodiments, when the B amino acid is proline, the A amino acid is from Subcategory IIA.

Sub-Category IIIB: A-B Linked to an Aromatic Amino Group of Q

In some embodiments, A-B is linked to Q through an amide bond between A-B and an aromatic amino group of a side chain of an amino acid of Q to result in a prodrug with a chemical cleavage half-life ($t_{1/2}$) of A-B from Q of at least about 1 hour to about 1 week in PBS, under physiological conditions, as previously described herein. For example, a dipeptide prodrug element having a B amino acid from any of sub-categories IA, IB, and IC and an A amino acid from any of sub-categories IIA and IIB can be linked to an aromatic amino group of a side chain of an amino acid of Q to result in a prodrug with a chemical cleavage half-life ($t_{1/2}$) of A-B from Q of at least about 1 hour to about 1 week in PBS, under physiological conditions.

Any of the B amino acids defined by Category I can be combined with any of the A amino acids defined by Category II to form a dipeptide prodrug element. This dipeptide prodrug element can be linked to any of the positions described in Category III. The half life of the prodrug can be tuned through the selection of:
(i) the number of substituents on the alpha position of the A amino acid;
(ii) the degree of N-alkylation of the A and the B amino acids;
(iii) the number of substituents on the beta position of the B amino acid;
(iv) the bulkiness of the side chain of the B amino acid; and,
(iii) the steric hindrance, nucleophilicity, and stability of the leaving group on Q during diketopiperazine formation.

Modification of Dipeptide Prodrug Element A-B

The dipeptide prodrug elements described above can be further modified to comprise a hydrophilic moiety, an acyl group, or an alkyl group, as previously described herein. In some embodiments, the dipeptide prodrug element includes lysine that is conjugated to an acyl group or an alkyl group through its side chain amino group. In some embodiments, the dipeptide prodrug element includes cysteine that is conjugated to a hydrophilic moiety (e.g., 40 kD PEG) through the side chain sulfhydryl group. The hydrophilic moiety, acyl group, or alkyl group can be conjugated directly to the dipeptide prodrug element or through a spacer. In some exemplary embodiments, the hydrophilic group, the alkyl group and/or the acyl group are conjugated to the A amino acid of the dipeptide prodrug element.

In some embodiments, the following dipeptide prodrug elements are PEGylated: dCys-Gly(N-Hexyl) dCys-Gly(N-Methyl), and dCys-Phe(N-Methyl). In some embodiments, the following dipeptide prodrug elements include an acyl group: dLys-Gly(N-Hexyl), dLys-Gly(N-Methyl), and dLys-Phe(N-Methyl). In some embodiments, the following dipeptide prodrug elements include an alkyl group: dLys-Gly(N-Hexyl), dLys-Gly(N-Methyl), and dLys-Phe(N-Methyl).

Exemplary Embodiments

The dipeptide prodrug element of the invention can include combinations of any of the B amino acids from Category I with any of the A amino acids from Category II. Nonlimiting examples of amino acids suitable for the A amino acid and for the B amino acid of the dipeptide prodrug element are listed in the below Table.

| Amino Acid # | Amino Acid 'A' | Amino Acid 'B' |
| --- | --- | --- |
| 1 | Aib | Gly(N—$C_1$-$C_8$alkyl) |
| 2 | Gly | Ala(N—$C_1$-$C_8$alkyl) |
| 3 | Ala | Leu(N—$C_1$-$C_8$alkyl) |
| 4 | Leu | Met(N—$C_1$-$C_8$alkyl) |
| 5 | Met | Asn(N—$C_1$-$C_8$alkyl) |
| 6 | Asn | Glu(N—$C_1$-$C_8$alkyl) |
| 7 | Glu | Asp(N—$C_1$-$C_8$alkyl) |
| 8 | Asp | Gln(N—$C_1$-$C_8$alkyl) |
| 9 | Gln | His(N—$C_1$-$C_8$alkyl) |
| 10 | His | Lys(N—$C_1$-$C_8$alkyl) |
| 11 | Lys | Arg(N—$C_1$-$C_8$alkyl) |
| 12 | Arg | Ser(N—$C_1$-$C_8$alkyl) |
| 13 | Ser | Cys(N—$C_1$-$C_8$alkyl) |
| 14 | Cys | Pro |
| 15 | Pro | Phe(N—$C_1$-$C_8$alkyl) |
| 16 | Phe | Tyr(N—$C_1$-$C_8$alkyl) |
| 17 | Tyr | Trp(N—$C_1$-$C_8$alkyl) |
| 18 | Trp | Ile(N—$C_1$-$C_8$alkyl) |
| 19 | Ile | Val(N—$C_1$-$C_8$alkyl) |
| 20 | Val | Thr(N—$C_1$-$C_8$alkyl) |
| 21 | Thr | d-Ala(N—$C_1$-$C_8$alkyl) |
| 22 | d-Ala | d-Leu(N—$C_1$-$C_8$alkyl) |
| 23 | d-Leu | d-Met(N—$C_1$-$C_8$alkyl) |
| 24 | d-Met | d-Asn(N—$C_1$-$C_8$alkyl) |
| 25 | d-Asn | d-Glu(N—$C_1$-$C_8$alkyl) |
| 26 | d-Glu | d-Asp(N—$C_1$-$C_8$alkyl) |
| 27 | d-Asp | d-Gln(N—$C_1$-$C_8$alkyl) |
| 28 | d-Gln | d-His(N—$C_1$-$C_8$alkyl) |
| 29 | d-His | d-Lys(N—$C_1$-$C_8$alkyl) |
| 30 | d-Lys | d-Arg(N—$C_1$-$C_8$alkyl) |
| 31 | d-Arg | d-Ser(N—$C_1$-$C_8$alkyl) |
| 32 | d-Ser | d-Cys(N—$C_1$-$C_8$alkyl) |
| 33 | d-Cys | d-Pro |
| 34 | d-Pro | d-Phe(N—$C_1$-$C_8$alkyl) |
| 35 | d-Phe | d-Tyr(N—$C_1$-$C_8$alkyl) |
| 36 | d-Tyr | d-Trp(N—$C_1$-$C_8$alkyl) |
| 37 | d-Trp | d-Ile(N—$C_1$-$C_8$alkyl) |
| 38 | d-Ile | d-Val(N—$C_1$-$C_8$alkyl) |

-continued

| Amino Acid # | Amino Acid 'A' | Amino Acid 'B' |
|---|---|---|
| 39 | d-Val | d-Thr(N—$C_1$-$C_8$alkyl) |
| 40 | d-Thr | Gly(N-methyl) |
| 41 | Gly(N-methyl) | Ala(N-methyl) |
| 42 | Ala(N-methyl) | Leu(N-methyl) |
| 43 | Leu(N-methyl) | Met(N-methyl) |
| 44 | Met(N-methyl) | Asn(N-methyl) |
| 45 | Asn(N-methyl) | Glu(N-methyl) |
| 46 | Glu(N-methyl) | Asp(N-methyl) |
| 47 | Asp(N-methyl) | Gln(N-methyl) |
| 48 | Gln(N-methyl) | His(N-methyl) |
| 49 | His(N-methyl) | Lys(N-methyl) |
| 50 | Lys(N-methyl) | Arg(N-methyl) |
| 51 | Arg(N-methyl) | Ser(N-methyl) |
| 52 | Ser(N-methyl) | Cys(N-methyl) |
| 53 | Cys(N-methyl) | Phe(N-methyl) |
| 54 | Phe(N-methyl) | Tyr(N-methyl) |
| 55 | Tyr(N-methyl) | Trp(N-methyl) |
| 56 | Trp(N-methyl) | Ile(N-methyl) |
| 57 | Ile(N-methyl) | Val(N-methyl) |
| 58 | Val(N-methyl) | Thr(N-methyl) |
| 59 | Thr(N-methyl) | d-Ala(N-methyl) |
| 60 | d-Ala(N-methyl) | d-Leu(N-methyl) |
| 61 | d-Leu(N-methyl) | d-Met(N-methyl) |
| 62 | d-Met(N-methyl) | d-Asn(N-methyl) |
| 63 | d-Asn(N-methyl) | d-Glu(N-methyl) |
| 64 | d-Glu(N-methyl) | d-Asp(N-methyl) |
| 65 | d-Asp(N-methyl) | d-Gln(N-methyl) |
| 66 | d-Gln(N-methyl) | d-His(N-methyl) |
| 67 | d-His(N-methyl) | d-Lys(N-methyl) |
| 68 | d-Lys(N-methyl) | d-Arg(N-methyl) |
| 69 | d-Arg(N-methyl) | d-Ser(N-methyl) |
| 70 | d-Ser(N-methyl) | d-Cys(N-methyl) |
| 71 | d-Cys(N-methyl) | d-Phe(N-methyl) |
| 72 | d-Phe(N-methyl) | d-Tyr(N-methyl) |
| 73 | d-Tyr(N-methyl) | d-Trp(N-methyl) |
| 74 | d-Trp(N-methyl) | d-Ile(N-methyl) |
| 75 | d-Ile(N-methyl) | d-Val(N-methyl) |
| 76 | d-Val(N-methyl) | d-Thr(N-methyl) |
| 77 | d-Thr(N-methyl) | Gly(N-hexyl) |
| 78 | | Ala(N-hexyl) |
| 79 | | Leu(N-hexyl) |
| 80 | | Met(N-hexyl) |
| 81 | | Asn(N-hexyl) |
| 82 | | Glu(N-hexyl) |
| 83 | | Asp(N-hexyl) |
| 84 | | Gln(N-hexyl) |
| 85 | | His(N-hexyl) |
| 86 | | Lys(N-hexyl) |
| 87 | | Arg(N-hexyl) |
| 88 | | Ser(N-hexyl) |
| 89 | | Cys(N-hexyl) |
| 90 | | Phe(N-hexyl) |
| 91 | | Tyr(N-hexyl) |
| 92 | | Trp(N-hexyl) |
| 93 | | Ile(N-hexyl) |
| 94 | | Val(N-hexyl) |
| 95 | | Thr(N-hexyl) |
| 96 | | d-Ala(N-hexyl) |
| 97 | | d-Leu(N-hexyl) |
| 98 | | d-Met(N-hexyl) |
| 99 | | d-Asn(N-hexyl) |
| 100 | | d-Glu(N-hexyl) |
| 101 | | d-Asp(N-hexyl) |
| 102 | | d-Gln(N-hexyl) |
| 103 | | d-His(N-hexyl) |
| 104 | | d-Lys(N-hexyl) |
| 105 | | d-Arg(N-hexyl) |
| 106 | | d-Ser(N-hexyl) |
| 107 | | d-Cys(N-hexyl) |
| 108 | | d-Phe(N-hexyl) |
| 109 | | d-Tyr(N-hexyl) |
| 110 | | d-Trp(N-hexyl) |
| 111 | | d-Ile(N-hexyl) |
| 112 | | d-Val(N-hexyl) |
| 113 | | d-Thr(N-hexyl) |

In some embodiments, the dipeptide prodrug element includes the combination of any one of A1-A77 with any one of B1-B113. For example, combinations of the A amino acid and the B amino acid of the dipeptide prodrug element can include: A1-B1; A1-B2; A1-B3; A1-B4; A1-B5; A1-B6; A1-B7; A1-B8; A1-B9; A1-B10; A1-B11; A1-B12; A1-B13; A1-B14; A1-B15; A1-B16; A1-B17; A1-B18; A1-B19; A1-B20; A1-B21; A1-B22; A1-B23; A1-B24; A1-B25; A1-B26; A1-B27; A1-B28; A1-B29; A1-B30; A1-B31; A1-B32; A1-B33; A1-B34; A1-B35; A1-B36; A1-B37; A1-B38; A1-B39; A1-B40; A1-B41; A1-B42; A1-B43; A1-B44; A1-B45; A1-B46; A1-B47; A1-B48; A1-B49; A1-B50; A1-B51; A1-B52; A1-B53; A1-B54; A1-B55; A1-B56; A1-B57; A1-B58; A1-B59; A1-B60; A1-B61; A1-B62; A1-B63; A1-B64; A1-B65; A1-B66; A1-B67; A1-B68; A1-B69; A1-B70; A1-B71; A1-B72; A1-B73; A1-B74; A1-B75; A1-B76; A1-B77; A1-B78; A1-B79; A1-B80; A1-B81; A1-B82; A1-B83; A1-B84; A1-B85; A1-B86; A1-B87; A1-B88; A1-B89; A1-B90; A1-B91; A1-B92; A1-B93; A1-B94; A1-B95; A1-B96; A1-B97; A1-B98; A1-B99; A1-B100; A1-B101; A1-B102; A1-B103; A1-B104; A1-B105; A1-B106; A1-B107; A1-B108; A1-B109; A1-B110; A1-B111; A1-B112; A1-B113;

A2-B1; A2-B2; A2-B3; A2-B4; A2-B5; A2-B6; A2-B7; A2-B8; A2-B9; A2-B10; A2-B11; A2-B12; A2-B13; A2-B14; A2-B15; A2-B16; A2-B17; A2-B18; A2-B19; A2-B20; A2-B21; A2-B22; A2-B23; A2-B24; A2-B25; A2-B26; A2-B27; A2-B28; A2-B29; A2-B30; A2-B31; A2-B32; A2-B33; A2-B34; A2-B35; A2-B36; A2-B37; A2-B38; A2-B39; A2-B40; A2-B41; A2-B42; A2-B43; A2-B44; A2-B45; A2-B46; A2-B47; A2-B48; A2-B49; A2-B50; A2-B51; A2-B52; A2-B53; A2-B54; A2-B55; A2-B56; A2-B57; A2-B58; A2-B59; A2-B60; A2-B61; A2-B62; A2-B63; A2-B64; A2-B65; A2-B66; A2-B67; A2-B68; A2-B69; A2-B70; A2-B71; A2-B72; A2-B73; A2-B74; A2-B75; A2-B76; A2-B77; A2-B78; A2-B79; A2-B80; A2-B81; A2-B82; A2-B83; A2-B84; A2-B85; A2-B86; A2-B87; A2-B88; A2-B89; A2-B90; A2-B91; A2-B92; A2-B93; A2-B94; A2-B95; A2-B96; A2-B97; A2-B98; A2-B99; A2-B100; A2-B101; A2-B102; A2-B103; A2-B104; A2-B105; A2-B106; A2-B107; A2-B108; A2-B109; A2-B110; A2-B111; A2-B112; A2-B113;

A3-B1; A3-B2; A3-B3; A3-B4; A3-B5; A3-B6; A3-B7; A3-B8; A3-B9; A3-B10; A3-B11; A3-B12; A3-B13; A3-B14; A3-B15; A3-B16; A3-B17; A3-B18; A3-B19; A3-B20; A3-B21; A3-B22; A3-B23; A3-B24; A3-B25; A3-B26; A3-B27; A3-B28; A3-B29; A3-B30; A3-B31; A3-B32; A3-B33; A3-B34; A3-B35; A3-B36; A3-B37; A3-B38; A3-B39; A3-B40; A3-B41; A3-B42; A3-B43; A3-B44; A3-B45; A3-B46; A3-B47; A3-B48; A3-B49; A3-B50; A3-B51; A3-B52; A3-B53; A3-B54; A3-B55; A3-B56; A3-B57; A3-B58; A3-B59; A3-B60; A3-B61; A3-B62; A3-B63; A3-B64; A3-B65; A3-B66; A3-B67; A3-B68; A3-B69; A3-B70; A3-B71; A3-B72; A3-B73; A3-B74; A3-B75; A3-B76; A3-B77; A3-B78; A3-B79; A3-B80; A3-B81; A3-B82; A3-B83; A3-B84; A3-B85; A3-B86; A3-B87; A3-B88; A3-B89; A3-B90; A3-B91; A3-B92; A3-B93; A3-B94; A3-B95; A3-B96; A3-B97; A3-B98; A3-B99; A3-B100; A3-B101; A3-B102; A3-B103; A3-B104; A3-B105; A3-B106; A3-B107; A3-B108; A3-B109; A3-B110; A3-B111; A3-B112; A3-B113;

A4-B1; A4-B2; A4-B3; A4-B4; A4-B5; A4-B6; A4-B7; A4-B8; A4-B9; A4-B10; A4-B11; A4-B12; A4-B13; A4-B14; A4-B15; A4-B16; A4-B17; A4-B18; A4-B19; A4-B20; A4-B21; A4-B22; A4-B23; A4-B24; A4-B25; A4-B26; A4-B27; A4-B28; A4-B29; A4-B30; A4-B31; A4-B32; A4-B33; A4-B34; A4-B35; A4-B36; A4-B37; A4-B38; A4-B39; A4-B40; A4-B41; A4-B42; A4-B43; A4-B44; A4-B45; A4-B46; A4-B47; A4-B48; A4-B49;

A4-B50; A4-B51; A4-B52; A4-B53; A4-B54; A4-B55; A4-B56; A4-B57; A4-B58; A4-B59; A4-B60; A4-B61; A4-B62; A4-B63; A4-B64; A4-B65; A4-B66; A4-B67; A4-B68; A4-B69; A4-B70; A4-B71; A4-B72; A4-B73; A4-B74; A4-B75; A4-B76; A4-B77; A4-B78; A4-B79; A4-B80; A4-B81; A4-B82; A4-B83; A4-B84; A4-B85; A4-B86; A4-B87; A4-B88; A4-B89; A4-B90; A4-B91; A4-B92; A4-B93; A4-B94; A4-B95; A4-B96; A4-B97; A4-B98; A4-B99; A4-B100; A4-B101; A4-B102; A4-B103; A4-B104; A4-B105; A4-B106; A4-B107; A4-B108; A4-B109; A4-B110; A4-B111; A4-B112; A4-B113;

A5-B1; A5-B2; A5-B3; A5-B4; A5-B5; A5-B6; A5-B7; A5-B8; A5-B9; A5-B10; A5-B11; A5-B12; A5-B13; A5-B14; A5-B15; A5-B16; A5-B17; A5-B18; A5-B19; A5-B20; A5-B21; A5-B22; A5-B23; A5-B24; A5-B25; A5-B26; A5-B27; A5-B28; A5-B29; A5-B30; A5-B31; A5-B32; A5-B33; A5-B34; A5-B35; A5-B36; A5-B37; A5-B38; A5-B39; A5-B40; A5-B41; A5-B42; A5-B43; A5-B44; A5-B45; A5-B46; A5-B47; A5-B48; A5-B49; A5-B50; A5-B51; A5-B52; A5-B53; A5-B54; A5-B55; A5-B56; A5-B57; A5-B58; A5-B59; A5-B60; A5-B61; A5-B62; A5-B63; A5-B64; A5-B65; A5-B66; A5-B67; A5-B68; A5-B69; A5-B70; A5-B71; A5-B72; A5-B73; A5-B74; A5-B75; A5-B76; A5-B77; A5-B78; A5-B79; A5-B80; A5-B81; A5-B82; A5-B83; A5-B84; A5-B85; A5-B86; A5-B87; A5-B88; A5-B89; A5-B90; A5-B91; A5-B92; A5-B93; A5-B94; A5-B95; A5-B96; A5-B97; A5-B98; A5-B99; A5-B100; A5-B101; A5-B102; A5-B103; A5-B104; A5-B105; A5-B106; A5-B107; A5-B108; A5-B109; A5-B110; A5-B111; A5-B112; A5-B113;

A6-B1; A6-B2; A6-B3; A6-B4; A6-B5; A6-B6; A6-B7; A6-B8; A6-B9; A6-B10; A6-B11; A6-B12; A6-B13; A6-B14; A6-B15; A6-B16; A6-B17; A6-B18; A6-B19; A6-B20; A6-B21; A6-B22; A6-B23; A6-B24; A6-B25; A6-B26; A6-B27; A6-B28; A6-B29; A6-B30; A6-B31; A6-B32; A6-B33; A6-B34; A6-B35; A6-B36; A6-B37; A6-B38; A6-B39; A6-B40; A6-B41; A6-B42; A6-B43; A6-B44; A6-B45; A6-B46; A6-B47; A6-B48; A6-B49; A6-B50; A6-B51; A6-B52; A6-B53; A6-B54; A6-B55; A6-B56; A6-B57; A6-B58; A6-B59; A6-B60; A6-B61; A6-B62; A6-B63; A6-B64; A6-B65; A6-B66; A6-B67; A6-B68; A6-B69; A6-B70; A6-B71; A6-B72; A6-B73; A6-B74; A6-B75; A6-B76; A6-B77; A6-B78; A6-B79; A6-B80; A6-B81; A6-B82; A6-B83; A6-B84; A6-B85; A6-B86; A6-B87; A6-B88; A6-B89; A6-B90; A6-B91; A6-B92; A6-B93; A6-B94; A6-B95; A6-B96; A6-B97; A6-B98; A6-B99; A6-B100; A6-B101; A6-B102; A6-B103; A6-B104; A6-B105; A6-B106; A6-B107; A6-B108; A6-B109; A6-B110; A6-B111; A6-B112; A6-B113;

A7-B1; A7-B2; A7-B3; A7-B4; A7-B5; A7-B6; A7-B7; A7-B8; A7-B9; A7-B10; A7-B11; A7-B12; A7-B13; A7-B14; A7-B15; A7-B16; A7-B17; A7-B18; A7-B19; A7-B20; A7-B21; A7-B22; A7-B23; A7-B24; A7-B25; A7-B26; A7-B27; A7-B28; A7-B29; A7-B30; A7-B31; A7-B32; A7-B33; A7-B34; A7-B35; A7-B36; A7-B37; A7-B38; A7-B39; A7-B40; A7-B41; A7-B42; A7-B43; A7-B44; A7-B45; A7-B46; A7-B47; A7-B48; A7-B49; A7-B50; A7-B51; A7-B52; A7-B53; A7-B54; A7-B55; A7-B56; A7-B57; A7-B58; A7-B59; A7-B60; A7-B61; A7-B62; A7-B63; A7-B64; A7-B65; A7-B66; A7-B67; A7-B68; A7-B69; A7-B70; A7-B71; A7-B72; A7-B73; A7-B74; A7-B75; A7-B76; A7-B77; A7-B78; A7-B79; A7-B80; A7-B81; A7-B82; A7-B83; A7-B84; A7-B85; A7-B86; A7-B87; A7-B88; A7-B89; A7-B90; A7-B91; A7-B92; A7-B93; A7-B94; A7-B95; A7-B96; A7-B97; A7-B98; A7-B99; A7-B100; A7-B101; A7-B102; A7-B103; A7-B104; A7-B105; A7-B106; A7-B107; A7-B108; A7-B109; A7-B110; A7-B111; A7-B112; A7-B113;

A8-B1; A8-B2; A8-B3; A8-B4; A8-B5; A8-B6; A8-B7; A8-B8; A8-B9; A8-B10; A8-B11; A8-B12; A8-B13; A8-B14; A8-B15; A8-B16; A8-B17; A8-B18; A8-B19; A8-B20; A8-B21; A8-B22; A8-B23; A8-B24; A8-B25; A8-B26; A8-B27; A8-B28; A8-B29; A8-B30; A8-B31; A8-B32; A8-B33; A8-B34; A8-B35; A8-B36; A8-B37; A8-B38; A8-B39; A8-B40; A8-B41; A8-B42; A8-B43; A8-B44; A8-B45; A8-B46; A8-B47; A8-B48; A8-B49; A8-B50; A8-B51; A8-B52; A8-B53; A8-B54; A8-B55; A8-B56; A8-B57; A8-B58; A8-B59; A8-B60; A8-B61; A8-B62; A8-B63; A8-B64; A8-B65; A8-B66; A8-B67; A8-B68; A8-B69; A8-B70; A8-B71; A8-B72; A8-B73; A8-B74; A8-B75; A8-B76; A8-B77; A8-B78; A8-B79; A8-B80; A8-B81; A8-B82; A8-B83; A8-B84; A8-B85; A8-B86; A8-B87; A8-B88; A8-B89; A8-B90; A8-B91; A8-B92; A8-B93; A8-B94; A8-B95; A8-B96; A8-B97; A8-B98; A8-B99; A8-B100; A8-B101; A8-B102; A8-B103; A8-B104; A8-B105; A8-B106; A8-B107; A8-B108; A8-B109; A8-B110; A8-B111; A8-B112; A8-B113;

A9-B1; A9-B2; A9-B3; A9-B4; A9-B5; A9-B6; A9-B7; A9-B8; A9-B9; A9-B10; A9-B11; A9-B12; A9-B13; A9-B14; A9-B15; A9-B16; A9-B17; A9-B18; A9-B19; A9-B20; A9-B21; A9-B22; A9-B23; A9-B24; A9-B25; A9-B26; A9-B27; A9-B28; A9-B29; A9-B30; A9-B31; A9-B32; A9-B33; A9-B34; A9-B35; A9-B36; A9-B37; A9-B38; A9-B39; A9-B40; A9-B41; A9-B42; A9-B43; A9-B44; A9-B45; A9-B46; A9-B47; A9-B48; A9-B49; A9-B50; A9-B51; A9-B52; A9-B53; A9-B54; A9-B55; A9-B56; A9-B57; A9-B58; A9-B59; A9-B60; A9-B61; A9-B62; A9-B63; A9-B64; A9-B65; A9-B66; A9-B67; A9-B68; A9-B69; A9-B70; A9-B71; A9-B72; A9-B73; A9-B74; A9-B75; A9-B76; A9-B77; A9-B78; A9-B79; A9-B80; A9-B81; A9-B82; A9-B83; A9-B84; A9-B85; A9-B86; A9-B87; A9-B88; A9-B89; A9-B90; A9-B91; A9-B92; A9-B93; A9-B94; A9-B95; A9-B96; A9-B97; A9-B98; A9-B99; A9-B100; A9-B101; A9-B102; A9-B103; A9-B104; A9-B105; A9-B106; A9-B107; A9-B108; A9-B109; A9-B110; A9-B111; A9-B112; A9-B113;

A10-B1; A10-B2; A10-B3; A10-B4; A10-B5; A10-B6; A10-B7; A10-B8; A10-B9; A10-B10; A10-B11; A10-B12; A10-B13; A10-B14; A10-B15; A10-B16; A10-B17; A10-B18; A10-B19; A10-B20; A10-B21; A10-B22; A10-B23; A10-B24; A10-B25; A10-B26; A10-B27; A10-B28; A10-B29; A10-B30; A10-B31; A10-B32; A10-B33; A10-B34; A10-B35; A10-B36; A10-B37; A10-B38; A10-B39; A10-B40; A10-B41; A10-B42; A10-B43; A10-B44; A10-B45; A10-B46; A10-B47; A10-B48; A10-B49; A10-B50; A10-B51; A10-B52; A10-B53; A10-B54; A10-B55; A10-B56; A10-B57; A10-B58; A10-B59; A10-B60; A10-B61; A10-B62; A10-B63; A10-B64; A10-B65; A10-B66; A10-B67; A10-B68; A10-B69; A10-B70; A10-B71; A10-B72; A10-B73; A10-B74; A10-B75; A10-B76; A10-B77; A10-B78; A10-B79; A10-B80; A10-B81; A10-B82; A10-B83; A10-B84; A10-B85; A10-B86; A10-B87; A10-B88; A10-B89; A10-B90; A10-B91; A10-B92; A10-B93; A10-B94; A10-B95; A10-B96; A10-B97; A10-B98; A10-B99; A10-B100; A10-B101; A10-B102; A10-B103; A10-B104; A10-B105; A10-B106; A10-B107; A10-B108; A10-B109; A10-B110; A10-B111; A10-B112; A10-B113;

A11-B1; A11-B2; A11-B3; A11-B4; A11-B5; A11-B6; A11-B7; A11-B8; A11-B9; A11-B10; A11-B11; A11-B12; A11-B13; A11-B14; A11-B15; A11-B16; A11-B17; A11-B18; A11-B19; A11-B20; A11-B21; A11-B22; A11-B23; A11-B24; A11-B25; A11-B26; A11-B27; A11-B28; A11-B29; A11-B30; A11-B31; A11-B32; A11-B33; A11-B34;

A11-B35; A11-B36; A11-B37; A11-B38; A11-B39; A11-B40; A11-B41; A11-B42; A11-B43; A11-B44; A11-B45; A11-B46; A11-B47; A11-B48; A11-B49; A11-B50; A11-B51; A11-B52; A11-B53; A11-B54; A11-B55; A11-B56; A11-B57; A11-B58; A11-B59; A11-B60; A11-B61; A11-B62; A11-B63; A11-B64; A11-B65; A11-B66; A11-B67; A11-B68; A11-B69; A11-B70; A11-B71; A11-B72; A11-B73; A11-B74; A11-B75; A11-B76; A11-B77; A11-B78; A11-B79; A11-B80; A11-B81; A11-B82; A11-B83; A11-B84; A11-B85; A11-B86; A11-B87; A11-B88; A11-B89; A11-B90; A11-B91; A11-B92; A11-B93; A11-B94; A11-B95; A11-B96; A11-B97; A11-B98; A11-B99; A11-B100; A11-B101; A11-B102; A11-B103; A11-B104; A11-B105; A11-B106; A11-B107; A11-B108; A11-B109; A11-B110; A11-B111; A11-B112; A11-B113;

A12-B1; A12-B2; A12-B3; A12-B4; A12-B5; A12-B6; A12-B7; A12-B8; A12-B9; A12-B10; A12-B11; A12-B12; A12-B13; A12-B14; A12-B15; A12-B16; A12-B17; A12-B18; A12-B19; A12-B20; A12-B21; A12-B22; A12-B23; A12-B24; A12-B25; A12-B26; A12-B27; A12-B28; A12-B29; A12-B30; A12-B31; A12-B32; A12-B33; A12-B34; A12-B35; A12-B36; A12-B37; A12-B38; A12-B39; A12-B40; A12-B41; A12-B42; A12-B43; A12-B44; A12-B45; A12-B46; A12-B47; A12-B48; A12-B49; A12-B50; A12-B51; A12-B52; A12-B53; A12-B54; A12-B55; A12-B56; A12-B57; A12-B58; A12-B59; A12-B60; A12-B61; A12-B62; A12-B63; A12-B64; A12-B65; A12-B66; A12-B67; A12-B68; A12-B69; A12-B70; A12-B71; A12-B72; A12-B73; A12-B74; A12-B75; A12-B76; A12-B77; A12-B78; A12-B79; A12-B80; A12-B81; A12-B82; A12-B83; A12-B84; A12-B85; A12-B86; A12-B87; A12-B88; A12-B89; A12-B90; A12-B91; A12-B92; A12-B93; A12-B94; A12-B95; A12-B96; A12-B97; A12-B98; A12-B99; A12-B100; A12-B101; A12-B102; A12-B103; A12-B104; A12-B105; A12-B106; A12-B107; A12-B108; A12-B109; A12-B110; A12-B111; A12-B112; A12-B113;

A13-B1; A13-B2; A13-B3; A13-B4; A13-B5; A13-B6; A13-B7; A13-B8; A13-B9; A13-B10; A13-B11; A13-B12; A13-B13; A13-B14; A13-B15; A13-B16; A13-B17; A13-B18; A13-B19; A13-B20; A13-B21; A13-B22; A13-B23; A13-B24; A13-B25; A13-B26; A13-B27; A13-B28; A13-B29; A13-B30; A13-B31; A13-B32; A13-B33; A13-B34; A13-B35; A13-B36; A13-B37; A13-B38; A13-B39; A13-B40; A13-B41; A13-B42; A13-B43; A13-B44; A13-B45; A13-B46; A13-B47; A13-B48; A13-B49; A13-B50; A13-B51; A13-B52; A13-B53; A13-B54; A13-B55; A13-B56; A13-B57; A13-B58; A13-B59; A13-B60; A13-B61; A13-B62; A13-B63; A13-B64; A13-B65; A13-B66; A13-B67; A13-B68; A13-B69; A13-B70; A13-B71; A13-B72; A13-B73; A13-B74; A13-B75; A13-B76; A13-B77; A13-B78; A13-B79; A13-B80; A13-B81; A13-B82; A13-B83; A13-B84; A13-B85; A13-B86; A13-B87; A13-B88; A13-B89; A13-B90; A13-B91; A13-B92; A13-B93; A13-B94; A13-B95; A13-B96; A13-B97; A13-B98; A13-B99; A13-B100; A13-B101; A13-B102; A13-B103; A13-B104; A13-B105; A13-B106; A13-B107; A13-B108; A13-B109; A13-B110; A13-B111; A13-B112; A13-B113;

A14-B1; A14-B2; A14-B3; A14-B4; A14-B5; A14-B6; A14-B7; A14-B8; A14-B9; A14-B10; A14-B11; A14-B12; A14-B13; A14-B14; A14-B15; A14-B16; A14-B17; A14-B18; A14-B19; A14-B20; A14-B21; A14-B22; A14-B23; A14-B24; A14-B25; A14-B26; A14-B27; A14-B28; A14-B29; A14-B30; A14-B31; A14-B32; A14-B33; A14-B34; A14-B35; A14-B36; A14-B37; A14-B38; A14-B39; A14-B40; A14-B41; A14-B42; A14-B43; A14-B44; A14-B45; A14-B46; A14-B47; A14-B48; A14-B49; A14-B50; A14-B51; A14-B52; A14-B53; A14-B54; A14-B55; A14-B56; A14-B57; A14-B58; A14-B59; A14-B60; A14-B61; A14-B62; A14-B63; A14-B64; A14-B65; A14-B66; A14-B67; A14-B68; A14-B69; A14-B70; A14-B71; A14-B72; A14-B73; A14-B74; A14-B75; A14-B76; A14-B77; A14-B78; A14-B79; A14-B80; A14-B81; A14-B82; A14-B83; A14-B84; A14-B85; A14-B86; A14-B87; A14-B88; A14-B89; A14-B90; A14-B91; A14-B92; A14-B93; A14-B94; A14-B95; A14-B96; A14-B97; A14-B98; A14-B99; A14-B100; A14-B101; A14-B102; A14-B103; A14-B104; A14-B105; A14-B106; A14-B107; A14-B108; A14-B109; A14-B110; A14-B111; A14-B112; A14-B113;

A15-B1; A15-B2; A15-B3; A15-B4; A15-B5; A15-B6; A15-B7; A15-B8; A15-B9; A15-B10; A15-B11; A15-B12; A15-B13; A15-B14; A15-B15; A15-B16; A15-B17; A15-B18; A15-B19; A15-B20; A15-B21; A15-B22; A15-B23; A15-B24; A15-B25; A15-B26; A15-B27; A15-B28; A15-B29; A15-B30; A15-B31; A15-B32; A15-B33; A15-B34; A15-B35; A15-B36; A15-B37; A15-B38; A15-B39; A15-B40; A15-B41; A15-B42; A15-B43; A15-B44; A15-B45; A15-B46; A15-B47; A15-B48; A15-B49; A15-B50; A15-B51; A15-B52; A15-B53; A15-B54; A15-B55; A15-B56; A15-B57; A15-B58; A15-B59; A15-B60; A15-B61; A15-B62; A15-B63; A15-B64; A15-B65; A15-B66; A15-B67; A15-B68; A15-B69; A15-B70; A15-B71; A15-B72; A15-B73; A15-B74; A15-B75; A15-B76; A15-B77; A15-B78; A15-B79; A15-B80; A15-B81; A15-B82; A15-B83; A15-B84; A15-B85; A15-B86; A15-B87; A15-B88; A15-B89; A15-B90; A15-B91; A15-B92; A15-B93; A15-B94; A15-B95; A15-B96; A15-B97; A15-B98; A15-B99; A15-B100; A15-B101; A15-B102; A15-B103; A15-B104; A15-B105; A15-B106; A15-B107; A15-B108; A15-B109; A15-B110; A15-B111; A15-B112; A15-B113;

A16-B1; A16-B2; A16-B3; A16-B4; A16-B5; A16-B6; A16-B7; A16-B8; A16-B9; A16-B10; A16-B11; A16-B12; A16-B13; A16-B14; A16-B15; A16-B16; A16-B17; A16-B18; A16-B19; A16-B20; A16-B21; A16-B22; A16-B23; A16-B24; A16-B25; A16-B26; A16-B27; A16-B28; A16-B29; A16-B30; A16-B31; A16-B32; A16-B33; A16-B34; A16-B35; A16-B36; A16-B37; A16-B38; A16-B39; A16-B40; A16-B41; A16-B42; A16-B43; A16-B44; A16-B45; A16-B46; A16-B47; A16-B48; A16-B49; A16-B50; A16-B51; A16-B52; A16-B53; A16-B54; A16-B55; A16-B56; A16-B57; A16-B58; A16-B59; A16-B60; A16-B61; A16-B62; A16-B63; A16-B64; A16-B65; A16-B66; A16-B67; A16-B68; A16-B69; A16-B70; A16-B71; A16-B72; A16-B73; A16-B74; A16-B75; A16-B76; A16-B77; A16-B78; A16-B79; A16-B80; A16-B81; A16-B82; A16-B83; A16-B84; A16-B85; A16-B86; A16-B87; A16-B88; A16-B89; A16-B90; A16-B91; A16-B92; A16-B93; A16-B94; A16-B95; A16-B96; A16-B97; A16-B98; A16-B99; A16-B100; A16-B101; A16-B102; A16-B103; A16-B104; A16-B105; A16-B106; A16-B107; A16-B108; A16-B109; A16-B110; A16-B111; A16-B112; A16-B113;

A17-B1; A17-B2; A17-B3; A17-B4; A17-B5; A17-B6; A17-B7; A17-B8; A17-B9; A17-B10; A17-B11; A17-B12; A17-B13; A17-B14; A17-B15; A17-B16; A17-B17; A17-B18; A17-B19; A17-B20; A17-B21; A17-B22; A17-B23; A17-B24; A17-B25; A17-B26; A17-B27; A17-B28; A17-B29; A17-B30; A17-B31; A17-B32; A17-B33; A17-B34; A17-B35; A17-B36; A17-B37; A17-B38; A17-B39; A17-B40; A17-B41; A17-B42; A17-B43; A17-B44; A17-B45; A17-B46; A17-B47; A17-B48; A17-B49; A17-B50; A17-B51; A17-B52; A17-B53; A17-B54; A17-B55; A17-B56; A17-B57; A17-B58; A17-B59; A17-B60; A17-B61; A17-B62; A17-B63; A17-B64; A17-B65; A17-B66; A17-B67; A17-B68; A17-B69; A17-B70; A17-B71; A17-B72; A17-B73; A17-B74; A17-B75; A17-B76; A17-B77; A17-B78;

A17-B79; A17-B80; A17-B81; A17-B82; A17-B83; A17-B84; A17-B85; A17-B86; A17-B87; A17-B88; A17-B89; A17-B90; A17-B91; A17-B92; A17-B93; A17-B94; A17-B95; A17-B96; A17-B97; A17-B98; A17-B99; A17-B100; A17-B101; A17-B102; A17-B103; A17-B104; A17-B105; A17-B106; A17-B107; A17-B108; A17-B109; A17-B110; A17-B111; A17-B112; A17-B113;

A18-B1; A18-B2; A18-B3; A18-B4; A18-B5; A18-B6; A18-B7; A18-B8; A18-B9; A18-B10; A18-B11; A18-B12; A18-B13; A18-B14; A18-B15; A18-B16; A18-B17; A18-B18; A18-B19; A18-B20; A18-B21; A18-B22; A18-B23; A18-B24; A18-B25; A18-B26; A18-B27; A18-B28; A18-B29; A18-B30; A18-B31; A18-B32; A18-B33; A18-B34; A18-B35; A18-B36; A18-B37; A18-B38; A18-B39; A18-B40; A18-B41; A18-B42; A18-B43; A18-B44; A18-B45; A18-B46; A18-B47; A18-B48; A18-B49; A18-B50; A18-B51; A18-B52; A18-B53; A18-B54; A18-B55; A18-B56; A18-B57; A18-B58; A18-B59; A18-B60; A18-B61; A18-B62; A18-B63; A18-B64; A18-B65; A18-B66; A18-B67; A18-B68; A18-B69; A18-B70; A18-B71; A18-B72; A18-B73; A18-B74; A18-B75; A18-B76; A18-B77; A18-B78; A18-B79; A18-B80; A18-B81; A18-B82; A18-B83; A18-B84; A18-B85; A18-B86; A18-B87; A18-B88; A18-B89; A18-B90; A18-B91; A18-B92; A18-B93; A18-B94; A18-B95; A18-B96; A18-B97; A18-B98; A18-B99; A18-B100; A18-B101; A18-B102; A18-B103; A18-B104; A18-B105; A18-B106; A18-B107; A18-B108; A18-B109; A18-B110; A18-B111; A18-B112; A18-B113;

A19-B1; A19-B2; A19-B3; A19-B4; A19-B5; A19-B6; A19-B7; A19-B8; A19-B9; A19-B10; A19-B11; A19-B12; A19-B13; A19-B14; A19-B15; A19-B16; A19-B17; A19-B18; A19-B19; A19-B20; A19-B21; A19-B22; A19-B23; A19-B24; A19-B25; A19-B26; A19-B27; A19-B28; A19-B29; A19-B30; A19-B31; A19-B32; A19-B33; A19-B34; A19-B35; A19-B36; A19-B37; A19-B38; A19-B39; A19-B40; A19-B41; A19-B42; A19-B43; A19-B44; A19-B45; A19-B46; A19-B47; A19-B48; A19-B49; A19-B50; A19-B51; A19-B52; A19-B53; A19-B54; A19-B55; A19-B56; A19-B57; A19-B58; A19-B59; A19-B60; A19-B61; A19-B62; A19-B63; A19-B64; A19-B65; A19-B66; A19-B67; A19-B68; A19-B69; A19-B70; A19-B71; A19-B72; A19-B73; A19-B74; A19-B75; A19-B76; A19-B77; A19-B78; A19-B79; A19-B80; A19-B81; A19-B82; A19-B83; A19-B84; A19-B85; A19-B86; A19-B87; A19-B88; A19-B89; A19-B90; A19-B91; A19-B92; A19-B93; A19-B94; A19-B95; A19-B96; A19-B97; A19-B98; A19-B99; A19-B100; A19-B101; A19-B102; A19-B103; A19-B104; A19-B105; A19-B106; A19-B107; A19-B108; A19-B109; A19-B110; A19-B111; A19-B112; A19-B113;

A20-B1; A20-B2; A20-B3; A20-B4; A20-B5; A20-B6; A20-B7; A20-B8; A20-B9; A20-B10; A20-B11; A20-B12; A20-B13; A20-B14; A20-B15; A20-B16; A20-B17; A20-B18; A20-B19; A20-B20; A20-B21; A20-B22; A20-B23; A20-B24; A20-B25; A20-B26; A20-B27; A20-B28; A20-B29; A20-B30; A20-B31; A20-B32; A20-B33; A20-B34; A20-B35; A20-B36; A20-B37; A20-B38; A20-B39; A20-B40; A20-B41; A20-B42; A20-B43; A20-B44; A20-B45; A20-B46; A20-B47; A20-B48; A20-B49; A20-B50; A20-B51; A20-B52; A20-B53; A20-B54; A20-B55; A20-B56; A20-B57; A20-B58; A20-B59; A20-B60; A20-B61; A20-B62; A20-B63; A20-B64; A20-B65; A20-B66; A20-B67; A20-B68; A20-B69; A20-B70; A20-B71; A20-B72; A20-B73; A20-B74; A20-B75; A20-B76; A20-B77; A20-B78; A20-B79; A20-B80; A20-B81; A20-B82; A20-B83; A20-B84; A20-B85; A20-B86; A20-B87; A20-B88; A20-B89; A20-B90; A20-B91; A20-B92; A20-B93; A20-B94; A20-B95; A20-B96; A20-B97; A20-B98; A20-B99; A20-B100; A20-B101; A20-B102; A20-B103; A20-B104; A20-B105; A20-B106; A20-B107; A20-B108; A20-B109; A20-B110; A20-B111; A20-B112; A20-B113;

A21-B1; A21-B2; A21-B3; A21-B4; A21-B5; A21-B6; A21-B7; A21-B8; A21-B9; A21-B10; A21-B11; A21-B12; A21-B13; A21-B14; A21-B15; A21-B16; A21-B17; A21-B18; A21-B19; A21-B20; A21-B21; A21-B22; A21-B23; A21-B24; A21-B25; A21-B26; A21-B27; A21-B28; A21-B29; A21-B30; A21-B31; A21-B32; A21-B33; A21-B34; A21-B35; A21-B36; A21-B37; A21-B38; A21-B39; A21-B40; A21-B41; A21-B42; A21-B43; A21-B44; A21-B45; A21-B46; A21-B47; A21-B48; A21-B49; A21-B50; A21-B51; A21-B52; A21-B53; A21-B54; A21-B55; A21-B56; A21-B57; A21-B58; A21-B59; A21-B60; A21-B61; A21-B62; A21-B63; A21-B64; A21-B65; A21-B66; A21-B67; A21-B68; A21-B69; A21-B70; A21-B71; A21-B72; A21-B73; A21-B74; A21-B75; A21-B76; A21-B77; A21-B78; A21-B79; A21-B80; A21-B81; A21-B82; A21-B83; A21-B84; A21-B85; A21-B86; A21-B87; A21-B88; A21-B89; A21-B90; A21-B91; A21-B92; A21-B93; A21-B94; A21-B95; A21-B96; A21-B97; A21-B98; A21-B99; A21-B100; A21-B101; A21-B102; A21-B103; A21-B104; A21-B105; A21-B106; A21-B107; A21-B108; A21-B109; A21-B110; A21-B111; A21-B112; A21-B113;

A22-B1; A22-B2; A22-B3; A22-B4; A22-B5; A22-B6; A22-B7; A22-B8; A22-B9; A22-B10; A22-B11; A22-B12; A22-B13; A22-B14; A22-B15; A22-B16; A22-B17; A22-B18; A22-B19; A22-B20; A22-B21; A22-B22; A22-B23; A22-B24; A22-B25; A22-B26; A22-B27; A22-B28; A22-B29; A22-B30; A22-B31; A22-B32; A22-B33; A22-B34; A22-B35; A22-B36; A22-B37; A22-B38; A22-B39; A22-B40; A22-B41; A22-B42; A22-B43; A22-B44; A22-B45; A22-B46; A22-B47; A22-B48; A22-B49; A22-B50; A22-B51; A22-B52; A22-B53; A22-B54; A22-B55; A22-B56; A22-B57; A22-B58; A22-B59; A22-B60; A22-B61; A22-B62; A22-B63; A22-B64; A22-B65; A22-B66; A22-B67; A22-B68; A22-B69; A22-B70; A22-B71; A22-B72; A22-B73; A22-B74; A22-B75; A22-B76; A22-B77; A22-B78; A22-B79; A22-B80; A22-B81; A22-B82; A22-B83; A22-B84; A22-B85; A22-B86; A22-B87; A22-B88; A22-B89; A22-B90; A22-B91; A22-B92; A22-B93; A22-B94; A22-B95; A22-B96; A22-B97; A22-B98; A22-B99; A22-B100; A22-B101; A22-B102; A22-B103; A22-B104; A22-B105; A22-B106; A22-B107; A22-B108; A22-B109; A22-B110; A22-B111; A22-B112; A22-B113;

A23-B1; A23-B2; A23-B3; A23-B4; A23-B5; A23-B6; A23-B7; A23-B8; A23-B9; A23-B10; A23-B11; A23-B12; A23-B13; A23-B14; A23-B15; A23-B16; A23-B17; A23-B18; A23-B19; A23-B20; A23-B21; A23-B22; A23-B23; A23-B24; A23-B25; A23-B26; A23-B27; A23-B28; A23-B29; A23-B30; A23-B31; A23-B32; A23-B33; A23-B34; A23-B35; A23-B36; A23-B37; A23-B38; A23-B39; A23-B40; A23-B41; A23-B42; A23-B43; A23-B44; A23-B45; A23-B46; A23-B47; A23-B48; A23-B49; A23-B50; A23-B51; A23-B52; A23-B53; A23-B54; A23-B55; A23-B56; A23-B57; A23-B58; A23-B59; A23-B60; A23-B61; A23-B62; A23-B63; A23-B64; A23-B65; A23-B66; A23-B67; A23-B68; A23-B69; A23-B70; A23-B71; A23-B72; A23-B73; A23-B74; A23-B75; A23-B76; A23-B77; A23-B78; A23-B79; A23-B80; A23-B81; A23-B82; A23-B83; A23-B84; A23-B85; A23-B86; A23-B87; A23-B88; A23-B89; A23-B90; A23-B91; A23-B92; A23-B93; A23-B94; A23-B95; A23-B96; A23-B97; A23-B98; A23-B99; A23-B100; A23-B101; A23-B102; A23-B103; A23-B104; A23-B105; A23-B106; A23-B107; A23-B108; A23-B109; A23-B110; A23-B111; A23-B112; A23-B113;

A24-B1; A24-B2; A24-B3; A24-B4; A24-B5; A24-B6; A24-B7; A24-B8; A24-B9; A24-B10; A24-B11; A24-B12; A24-B13; A24-B14; A24-B15; A24-B16; A24-B17; A24-B18; A24-B19; A24-B20; A24-B21; A24-B22; A24-B23; A24-B24; A24-B25; A24-B26; A24-B27; A24-B28; A24-B29; A24-B30; A24-B31; A24-B32; A24-B33; A24-B34; A24-B35; A24-B36; A24-B37; A24-B38; A24-B39; A24-B40; A24-B41; A24-B42; A24-B43; A24-B44; A24-B45; A24-B46; A24-B47; A24-B48; A24-B49; A24-B50; A24-B51; A24-B52; A24-B53; A24-B54; A24-B55; A24-B56; A24-B57; A24-B58; A24-B59; A24-B60; A24-B61; A24-B62; A24-B63; A24-B64; A24-B65; A24-B66; A24-B67; A24-B68; A24-B69; A24-B70; A24-B71; A24-B72; A24-B73; A24-B74; A24-B75; A24-B76; A24-B77; A24-B78; A24-B79; A24-B80; A24-B81; A24-B82; A24-B83; A24-B84; A24-B85; A24-B86; A24-B87; A24-B88; A24-B89; A24-B90; A24-B91; A24-B92; A24-B93; A24-B94; A24-B95; A24-B96; A24-B97; A24-B98; A24-B99; A24-B100; A24-B101; A24-B102; A24-B103; A24-B104; A24-B105; A24-B106; A24-B107; A24-B108; A24-B109; A24-B110; A24-B111; A24-B112; A24-B113;

A25-B1; A25-B2; A25-B3; A25-B4; A25-B5; A25-B6; A25-B7; A25-B8; A25-B9; A25-B10; A25-B11; A25-B12; A25-B13; A25-B14; A25-B15; A25-B16; A25-B17; A25-B18; A25-B19; A25-B20; A25-B21; A25-B22; A25-B23; A25-B24; A25-B25; A25-B26; A25-B27; A25-B28; A25-B29; A25-B30; A25-B31; A25-B32; A25-B33; A25-B34; A25-B35; A25-B36; A25-B37; A25-B38; A25-B39; A25-B40; A25-B41; A25-B42; A25-B43; A25-B44; A25-B45; A25-B46; A25-B47; A25-B48; A25-B49; A25-B50; A25-B51; A25-B52; A25-B53; A25-B54; A25-B55; A25-B56; A25-B57; A25-B58; A25-B59; A25-B60; A25-B61; A25-B62; A25-B63; A25-B64; A25-B65; A25-B66; A25-B67; A25-B68; A25-B69; A25-B70; A25-B71; A25-B72; A25-B73; A25-B74; A25-B75; A25-B76; A25-B77; A25-B78; A25-B79; A25-B80; A25-B81; A25-B82; A25-B83; A25-B84; A25-B85; A25-B86; A25-B87; A25-B88; A25-B89; A25-B90; A25-B91; A25-B92; A25-B93; A25-B94; A25-B95; A25-B96; A25-B97; A25-B98; A25-B99; A25-B100; A25-B101; A25-B102; A25-B103; A25-B104; A25-B105; A25-B106; A25-B107; A25-B108; A25-B109; A25-B110; A25-B111; A25-B112; A25-B113;

A26-B1; A26-B2; A26-B3; A26-B4; A26-B5; A26-B6; A26-B7; A26-B8; A26-B9; A26-B10; A26-B11; A26-B12; A26-B13; A26-B14; A26-B15; A26-B16; A26-B17; A26-B18; A26-B19; A26-B20; A26-B21; A26-B22; A26-B23; A26-B24; A26-B25; A26-B26; A26-B27; A26-B28; A26-B29; A26-B30; A26-B31; A26-B32; A26-B33; A26-B34; A26-B35; A26-B36; A26-B37; A26-B38; A26-B39; A26-B40; A26-B41; A26-B42; A26-B43; A26-B44; A26-B45; A26-B46; A26-B47; A26-B48; A26-B49; A26-B50; A26-B51; A26-B52; A26-B53; A26-B54; A26-B55; A26-B56; A26-B57; A26-B58; A26-B59; A26-B60; A26-B61; A26-B62; A26-B63; A26-B64; A26-B65; A26-B66; A26-B67; A26-B68; A26-B69; A26-B70; A26-B71; A26-B72; A26-B73; A26-B74; A26-B75; A26-B76; A26-B77; A26-B78; A26-B79; A26-B80; A26-B81; A26-B82; A26-B83; A26-B84; A26-B85; A26-B86; A26-B87; A26-B88; A26-B89; A26-B90; A26-B91; A26-B92; A26-B93; A26-B94; A26-B95; A26-B96; A26-B97; A26-B98; A26-B99; A26-B100; A26-B101; A26-B102; A26-B103; A26-B104; A26-B105; A26-B106; A26-B107; A26-B108; A26-B109; A26-B110; A26-B111; A26-B112; A26-B113;

A27-B1; A27-B2; A27-B3; A27-B4; A27-B5; A27-B6; A27-B7; A27-B8; A27-B9; A27-B10; A27-B11; A27-B12; A27-B13; A27-B14; A27-B15; A27-B16; A27-B17; A27-B18; A27-B19; A27-B20; A27-B21; A27-B22; A27-B23; A27-B24; A27-B25; A27-B26; A27-B27; A27-B28; A27-B29; A27-B30; A27-B31; A27-B32; A27-B33; A27-B34; A27-B35; A27-B36; A27-B37; A27-B38; A27-B39; A27-B40; A27-B41; A27-B42; A27-B43; A27-B44; A27-B45; A27-B46; A27-B47; A27-B48; A27-B49; A27-B50; A27-B51; A27-B52; A27-B53; A27-B54; A27-B55; A27-B56; A27-B57; A27-B58; A27-B59; A27-B60; A27-B61; A27-B62; A27-B63; A27-B64; A27-B65; A27-B66; A27-B67; A27-B68; A27-B69; A27-B70; A27-B71; A27-B72; A27-B73; A27-B74; A27-B75; A27-B76; A27-B77; A27-B78; A27-B79; A27-B80; A27-B81; A27-B82; A27-B83; A27-B84; A27-B85; A27-B86; A27-B87; A27-B88; A27-B89; A27-B90; A27-B91; A27-B92; A27-B93; A27-B94; A27-B95; A27-B96; A27-B97; A27-B98; A27-B99; A27-B100; A27-B101; A27-B102; A27-B103; A27-B104; A27-B105; A27-B106; A27-B107; A27-B108; A27-B109; A27-B110; A27-B111; A27-B112; A27-B113;

A28-B1; A28-B2; A28-B3; A28-B4; A28-B5; A28-B6; A28-B7; A28-B8; A28-B9; A28-B10; A28-B11; A28-B12; A28-B13; A28-B14; A28-B15; A28-B16; A28-B17; A28-B18; A28-B19; A28-B20; A28-B21; A28-B22; A28-B23; A28-B24; A28-B25; A28-B26; A28-B27; A28-B28; A28-B29; A28-B30; A28-B31; A28-B32; A28-B33; A28-B34; A28-B35; A28-B36; A28-B37; A28-B38; A28-B39; A28-B40; A28-B41; A28-B42; A28-B43; A28-B44; A28-B45; A28-B46; A28-B47; A28-B48; A28-B49; A28-B50; A28-B51; A28-B52; A28-B53; A28-B54; A28-B55; A28-B56; A28-B57; A28-B58; A28-B59; A28-B60; A28-B61; A28-B62; A28-B63; A28-B64; A28-B65; A28-B66; A28-B67; A28-B68; A28-B69; A28-B70; A28-B71; A28-B72; A28-B73; A28-B74; A28-B75; A28-B76; A28-B77; A28-B78; A28-B79; A28-B80; A28-B81; A28-B82; A28-B83; A28-B84; A28-B85; A28-B86; A28-B87; A28-B88; A28-B89; A28-B90; A28-B91; A28-B92; A28-B93; A28-B94; A28-B95; A28-B96; A28-B97; A28-B98; A28-B99; A28-B100; A28-B101; A28-B102; A28-B103; A28-B104; A28-B105; A28-B106; A28-B107; A28-B108; A28-B109; A28-B110; A28-B111; A28-B112; A28-B113;

A29-B1; A29-B2; A29-B3; A29-B4; A29-B5; A29-B6; A29-B7; A29-B8; A29-B9; A29-B10; A29-B11; A29-B12; A29-B13; A29-B14; A29-B15; A29-B16; A29-B17; A29-B18; A29-B19; A29-B20; A29-B21; A29-B22; A29-B23; A29-B24; A29-B25; A29-B26; A29-B27; A29-B28; A29-B29; A29-B30; A29-B31; A29-B32; A29-B33; A29-B34; A29-B35; A29-B36; A29-B37; A29-B38; A29-B39; A29-B40; A29-B41; A29-B42; A29-B43; A29-B44; A29-B45; A29-B46; A29-B47; A29-B48; A29-B49; A29-B50; A29-B51; A29-B52; A29-B53; A29-B54; A29-B55; A29-B56; A29-B57; A29-B58; A29-B59; A29-B60; A29-B61; A29-B62; A29-B63; A29-B64; A29-B65; A29-B66; A29-B67; A29-B68; A29-B69; A29-B70; A29-B71; A29-B72; A29-B73; A29-B74; A29-B75; A29-B76; A29-B77; A29-B78; A29-B79; A29-B80; A29-B81; A29-B82; A29-B83; A29-B84; A29-B85; A29-B86; A29-B87; A29-B88; A29-B89; A29-B90; A29-B91; A29-B92; A29-B93; A29-B94; A29-B95; A29-B96; A29-B97; A29-B98; A29-B99; A29-B100; A29-B101; A29-B102; A29-B103; A29-B104; A29-B105; A29-B106; A29-B107; A29-B108; A29-B109; A29-B110; A29-B111; A29-B112; A29-B113;

A30-B1; A30-B2; A30-B3; A30-B4; A30-B5; A30-B6; A30-B7; A30-B8; A30-B9; A30-B10; A30-B11; A30-B12; A30-B13; A30-B14; A30-B15; A30-B16; A30-B17; A30-B18; A30-B19; A30-B20; A30-B21; A30-B22; A30-B23; A30-B24; A30-B25; A30-B26; A30-B27; A30-B28; A30-B29; A30-B30; A30-B31; A30-B32; A30-B33; A30-B34; A30-B35; A30-B36; A30-B37; A30-B38; A30-B39; A30-B40; A30-B41; A30-B42; A30-B43; A30-B44; A30-B45;

A30-B46; A30-B47; A30-B48; A30-B49; A30-B50; A30-B51; A30-B52; A30-B53; A30-B54; A30-B55; A30-B56; A30-B57; A30-B58; A30-B59; A30-B60; A30-B61; A30-B62; A30-B63; A30-B64; A30-B65; A30-B66; A30-B67; A30-B68; A30-B69; A30-B70; A30-B71; A30-B72; A30-B73; A30-B74; A30-B75; A30-B76; A30-B77; A30-B78; A30-B79; A30-B80; A30-B81; A30-B82; A30-B83; A30-B84; A30-B85; A30-B86; A30-B87; A30-B88; A30-B89; A30-B90; A30-B91; A30-B92; A30-B93; A30-B94; A30-B95; A30-B96; A30-B97; A30-B98; A30-B99; A30-B100; A30-B101; A30-B102; A30-B103; A30-B104; A30-B105; A30-B106; A30-B107; A30-B108; A30-B109; A30-B110; A30-B111; A30-B112; A30-B113;

A31-B1; A31-B2; A31-B3; A31-B4; A31-B5; A31-B6; A31-B7; A31-B8; A31-B9; A31-B10; A31-B11; A31-B12; A31-B13; A31-B14; A31-B15; A31-B16; A31-B17; A31-B18; A31-B19; A31-B20; A31-B21; A31-B22; A31-B23; A31-B24; A31-B25; A31-B26; A31-B27; A31-B28; A31-B29; A31-B30; A31-B31; A31-B32; A31-B33; A31-B34; A31-B35; A31-B36; A31-B37; A31-B38; A31-B39; A31-B40; A31-B41; A31-B42; A31-B43; A31-B44; A31-B45; A31-B46; A31-B47; A31-B48; A31-B49; A31-B50; A31-B51; A31-B52; A31-B53; A31-B54; A31-B55; A31-B56; A31-B57; A31-B58; A31-B59; A31-B60; A31-B61; A31-B62; A31-B63; A31-B64; A31-B65; A31-B66; A31-B67; A31-B68; A31-B69; A31-B70; A31-B71; A31-B72; A31-B73; A31-B74; A31-B75; A31-B76; A31-B77; A31-B78; A31-B79; A31-B80; A31-B81; A31-B82; A31-B83; A31-B84; A31-B85; A31-B86; A31-B87; A31-B88; A31-B89; A31-B90; A31-B91; A31-B92; A31-B93; A31-B94; A31-B95; A31-B96; A31-B97; A31-B98; A31-B99; A31-B100; A31-B101; A31-B102; A31-B103; A31-B104; A31-B105; A31-B106; A31-B107; A31-B108; A31-B109; A31-B110; A31-B111; A31-B112; A31-B113;

A32-B1; A32-B2; A32-B3; A32-B4; A32-B5; A32-B6; A32-B7; A32-B8; A32-B9; A32-B10; A32-B11; A32-B12; A32-B13; A32-B14; A32-B15; A32-B16; A32-B17; A32-B18; A32-B19; A32-B20; A32-B21; A32-B22; A32-B23; A32-B24; A32-B25; A32-B26; A32-B27; A32-B28; A32-B29; A32-B30; A32-B31; A32-B32; A32-B33; A32-B34; A32-B35; A32-B36; A32-B37; A32-B38; A32-B39; A32-B40; A32-B41; A32-B42; A32-B43; A32-B44; A32-B45; A32-B46; A32-B47; A32-B48; A32-B49; A32-B50; A32-B51; A32-B52; A32-B53; A32-B54; A32-B55; A32-B56; A32-B57; A32-B58; A32-B59; A32-B60; A32-B61; A32-B62; A32-B63; A32-B64; A32-B65; A32-B66; A32-B67; A32-B68; A32-B69; A32-B70; A32-B71; A32-B72; A32-B73; A32-B74; A32-B75; A32-B76; A32-B77; A32-B78; A32-B79; A32-B80; A32-B81; A32-B82; A32-B83; A32-B84; A32-B85; A32-B86; A32-B87; A32-B88; A32-B89; A32-B90; A32-B91; A32-B92; A32-B93; A32-B94; A32-B95; A32-B96; A32-B97; A32-B98; A32-B99; A32-B100; A32-B101; A32-B102; A32-B103; A32-B104; A32-B105; A32-B106; A32-B107; A32-B108; A32-B109; A32-B110; A32-B111; A32-B112; A32-B113;

A33-B1; A33-B2; A33-B3; A33-B4; A33-B5; A33-B6; A33-B7; A33-B8; A33-B9; A33-B10; A33-B11; A33-B12; A33-B13; A33-B14; A33-B15; A33-B16; A33-B17; A33-B18; A33-B19; A33-B20; A33-B21; A33-B22; A33-B23; A33-B24; A33-B25; A33-B26; A33-B27; A33-B28; A33-B29; A33-B30; A33-B31; A33-B32; A33-B33; A33-B34; A33-B35; A33-B36; A33-B37; A33-B38; A33-B39; A33-B40; A33-B41; A33-B42; A33-B43; A33-B44; A33-B45; A33-B46; A33-B47; A33-B48; A33-B49; A33-B50; A33-B51; A33-B52; A33-B53; A33-B54; A33-B55; A33-B56; A33-B57; A33-B58; A33-B59; A33-B60; A33-B61; A33-B62; A33-B63; A33-B64; A33-B65; A33-B66; A33-B67; A33-B68; A33-B69; A33-B70; A33-B71; A33-B72; A33-B73; A33-B74; A33-B75; A33-B76; A33-B77; A33-B78; A33-B79; A33-B80; A33-B81; A33-B82; A33-B83; A33-B84; A33-B85; A33-B86; A33-B87; A33-B88; A33-B89; A33-B90; A33-B91; A33-B92; A33-B93; A33-B94; A33-B95; A33-B96; A33-B97; A33-B98; A33-B99; A33-B100; A33-B101; A33-B102; A33-B103; A33-B104; A33-B105; A33-B106; A33-B107; A33-B108; A33-B109; A33-B110; A33-B111; A33-B112; A33-B113;

A34-B1; A34-B2; A34-B3; A34-B4; A34-B5; A34-B6; A34-B7; A34-B8; A34-B9; A34-B10; A34-B11; A34-B12; A34-B13; A34-B14; A34-B15; A34-B16; A34-B17; A34-B18; A34-B19; A34-B20; A34-B21; A34-B22; A34-B23; A34-B24; A34-B25; A34-B26; A34-B27; A34-B28; A34-B29; A34-B30; A34-B31; A34-B32; A34-B33; A34-B34; A34-B35; A34-B36; A34-B37; A34-B38; A34-B39; A34-B40; A34-B41; A34-B42; A34-B43; A34-B44; A34-B45; A34-B46; A34-B47; A34-B48; A34-B49; A34-B50; A34-B51; A34-B52; A34-B53; A34-B54; A34-B55; A34-B56; A34-B57; A34-B58; A34-B59; A34-B60; A34-B61; A34-B62; A34-B63; A34-B64; A34-B65; A34-B66; A34-B67; A34-B68; A34-B69; A34-B70; A34-B71; A34-B72; A34-B73; A34-B74; A34-B75; A34-B76; A34-B77; A34-B78; A34-B79; A34-B80; A34-B81; A34-B82; A34-B83; A34-B84; A34-B85; A34-B86; A34-B87; A34-B88; A34-B89; A34-B90; A34-B91; A34-B92; A34-B93; A34-B94; A34-B95; A34-B96; A34-B97; A34-B98; A34-B99; A34-B100; A34-B101; A34-B102; A34-B103; A34-B104; A34-B105; A34-B106; A34-B107; A34-B108; A34-B109; A34-B110; A34-B111; A34-B112; A34-B113;

A35-B1; A35-B2; A35-B3; A35-B4; A35-B5; A35-B6; A35-B7; A35-B8; A35-B9; A35-B10; A35-B11; A35-B12; A35-B13; A35-B14; A35-B15; A35-B16; A35-B17; A35-B18; A35-B19; A35-B20; A35-B21; A35-B22; A35-B23; A35-B24; A35-B25; A35-B26; A35-B27; A35-B28; A35-B29; A35-B30; A35-B31; A35-B32; A35-B33; A35-B34; A35-B35; A35-B36; A35-B37; A35-B38; A35-B39; A35-B40; A35-B41; A35-B42; A35-B43; A35-B44; A35-B45; A35-B46; A35-B47; A35-B48; A35-B49; A35-B50; A35-B51; A35-B52; A35-B53; A35-B54; A35-B55; A35-B56; A35-B57; A35-B58; A35-B59; A35-B60; A35-B61; A35-B62; A35-B63; A35-B64; A35-B65; A35-B66; A35-B67; A35-B68; A35-B69; A35-B70; A35-B71; A35-B72; A35-B73; A35-B74; A35-B75; A35-B76; A35-B77; A35-B78; A35-B79; A35-B80; A35-B81; A35-B82; A35-B83; A35-B84; A35-B85; A35-B86; A35-B87; A35-B88; A35-B89; A35-B90; A35-B91; A35-B92; A35-B93; A35-B94; A35-B95; A35-B96; A35-B97; A35-B98; A35-B99; A35-B100; A35-B101; A35-B102; A35-B103; A35-B104; A35-B105; A35-B106; A35-B107; A35-B108; A35-B109; A35-B110; A35-B111; A35-B112; A35-B113;

A36-B1; A36-B2; A36-B3; A36-B4; A36-B5; A36-B6; A36-B7; A36-B8; A36-B9; A36-B10; A36-B11; A36-B12; A36-B13; A36-B14; A36-B15; A36-B16; A36-B17; A36-B18; A36-B19; A36-B20; A36-B21; A36-B22; A36-B23; A36-B24; A36-B25; A36-B26; A36-B27; A36-B28; A36-B29; A36-B30; A36-B31; A36-B32; A36-B33; A36-B34; A36-B35; A36-B36; A36-B37; A36-B38; A36-B39; A36-B40; A36-B41; A36-B42; A36-B43; A36-B44; A36-B45; A36-B46; A36-B47; A36-B48; A36-B49; A36-B50; A36-B51; A36-B52; A36-B53; A36-B54; A36-B55; A36-B56; A36-B57; A36-B58; A36-B59; A36-B60; A36-B61; A36-B62; A36-B63; A36-B64; A36-B65; A36-B66; A36-B67; A36-B68; A36-B69; A36-B70; A36-B71; A36-B72; A36-B73; A36-B74; A36-B75; A36-B76; A36-B77; A36-B78; A36-B79; A36-B80; A36-B81; A36-B82; A36-B83; A36-B84; A36-B85; A36-B86; A36-B87; A36-B88; A36-B89;

A36-B90; A36-B91; A36-B92; A36-B93; A36-B94; A36-B95; A36-B96; A36-B97; A36-B98; A36-B99; A36-B100; A36-B101; A36-B102; A36-B103; A36-B104; A36-B105; A36-B106; A36-B107; A36-B108; A36-B109; A36-B110; A36-B111; A36-B112; A36-B113;

A37-B1; A37-B2; A37-B3; A37-B4; A37-B5; A37-B6; A37-B7; A37-B8; A37-B9; A37-B10; A37-B11; A37-B12; A37-B13; A37-B14; A37-B15; A37-B16; A37-B17; A37-B18; A37-B19; A37-B20; A37-B21; A37-B22; A37-B23; A37-B24; A37-B25; A37-B26; A37-B27; A37-B28; A37-B29; A37-B30; A37-B31; A37-B32; A37-B33; A37-B34; A37-B35; A37-B36; A37-B37; A37-B38; A37-B39; A37-B40; A37-B41; A37-B42; A37-B43; A37-B44; A37-B45; A37-B46; A37-B47; A37-B48; A37-B49; A37-B50; A37-B51; A37-B52; A37-B53; A37-B54; A37-B55; A37-B56; A37-B57; A37-B58; A37-B59; A37-B60; A37-B61; A37-B62; A37-B63; A37-B64; A37-B65; A37-B66; A37-B67; A37-B68; A37-B69; A37-B70; A37-B71; A37-B72; A37-B73; A37-B74; A37-B75; A37-B76; A37-B77; A37-B78; A37-B79; A37-B80; A37-B81; A37-B82; A37-B83; A37-B84; A37-B85; A37-B86; A37-B87; A37-B88; A37-B89; A37-B90; A37-B91; A37-B92; A37-B93; A37-B94; A37-B95; A37-B96; A37-B97; A37-B98; A37-B99; A37-B100; A37-B101; A37-B102; A37-B103; A37-B104; A37-B105; A37-B106; A37-B107; A37-B108; A37-B109; A37-B110; A37-B111; A37-B112; A37-B113;

A38-B1; A38-B2; A38-B3; A38-B4; A38-B5; A38-B6; A38-B7; A38-B8; A38-B9; A38-B10; A38-B11; A38-B12; A38-B13; A38-B14; A38-B15; A38-B16; A38-B17; A38-B18; A38-B19; A38-B20; A38-B21; A38-B22; A38-B23; A38-B24; A38-B25; A38-B26; A38-B27; A38-B28; A38-B29; A38-B30; A38-B31; A38-B32; A38-B33; A38-B34; A38-B35; A38-B36; A38-B37; A38-B38; A38-B39; A38-B40; A38-B41; A38-B42; A38-B43; A38-B44; A38-B45; A38-B46; A38-B47; A38-B48; A38-B49; A38-B50; A38-B51; A38-B52; A38-B53; A38-B54; A38-B55; A38-B56; A38-B57; A38-B58; A38-B59; A38-B60; A38-B61; A38-B62; A38-B63; A38-B64; A38-B65; A38-B66; A38-B67; A38-B68; A38-B69; A38-B70; A38-B71; A38-B72; A38-B73; A38-B74; A38-B75; A38-B76; A38-B77; A38-B78; A38-B79; A38-B80; A38-B81; A38-B82; A38-B83; A38-B84; A38-B85; A38-B86; A38-B87; A38-B88; A38-B89; A38-B90; A38-B91; A38-B92; A38-B93; A38-B94; A38-B95; A38-B96; A38-B97; A38-B98; A38-B99; A38-B100; A38-B101; A38-B102; A38-B103; A38-B104; A38-B105; A38-B106; A38-B107; A38-B108; A38-B109; A38-B110; A38-B111; A38-B112; A38-B113;

A39-B1; A39-B2; A39-B3; A39-B4; A39-B5; A39-B6; A39-B7; A39-B8; A39-B9; A39-B10; A39-B11; A39-B12; A39-B13; A39-B14; A39-B15; A39-B16; A39-B17; A39-B18; A39-B19; A39-B20; A39-B21; A39-B22; A39-B23; A39-B24; A39-B25; A39-B26; A39-B27; A39-B28; A39-B29; A39-B30; A39-B31; A39-B32; A39-B33; A39-B34; A39-B35; A39-B36; A39-B37; A39-B38; A39-B39; A39-B40; A39-B41; A39-B42; A39-B43; A39-B44; A39-B45; A39-B46; A39-B47; A39-B48; A39-B49; A39-B50; A39-B51; A39-B52; A39-B53; A39-B54; A39-B55; A39-B56; A39-B57; A39-B58; A39-B59; A39-B60; A39-B61; A39-B62; A39-B63; A39-B64; A39-B65; A39-B66; A39-B67; A39-B68; A39-B69; A39-B70; A39-B71; A39-B72; A39-B73; A39-B74; A39-B75; A39-B76; A39-B77; A39-B78; A39-B79; A39-B80; A39-B81; A39-B82; A39-B83; A39-B84; A39-B85; A39-B86; A39-B87; A39-B88; A39-B89; A39-B90; A39-B91; A39-B92; A39-B93; A39-B94; A39-B95; A39-B96; A39-B97; A39-B98; A39-B99; A39-B100; A39-B101; A39-B102; A39-B103; A39-B104; A39-B105; A39-B106; A39-B107; A39-B108; A39-B109; A39-B110; A39-B111; A39-B112; A39-B113;

A40-B1; A40-B2; A40-B3; A40-B4; A40-B5; A40-B6; A40-B7; A40-B8; A40-B9; A40-B10; A40-B11; A40-B12; A40-B13; A40-B14; A40-B15; A40-B16; A40-B17; A40-B18; A40-B19; A40-B20; A40-B21; A40-B22; A40-B23; A40-B24; A40-B25; A40-B26; A40-B27; A40-B28; A40-B29; A40-B30; A40-B31; A40-B32; A40-B33; A40-B34; A40-B35; A40-B36; A40-B37; A40-B38; A40-B39; A40-B40; A40-B41; A40-B42; A40-B43; A40-B44; A40-B45; A40-B46; A40-B47; A40-B48; A40-B49; A40-B50; A40-B51; A40-B52; A40-B53; A40-B54; A40-B55; A40-B56; A40-B57; A40-B58; A40-B59; A40-B60; A40-B61; A40-B62; A40-B63; A40-B64; A40-B65; A40-B66; A40-B67; A40-B68; A40-B69; A40-B70; A40-B71; A40-B72; A40-B73; A40-B74; A40-B75; A40-B76; A40-B77; A40-B78; A40-B79; A40-B80; A40-B81; A40-B82; A40-B83; A40-B84; A40-B85; A40-B86; A40-B87; A40-B88; A40-B89; A40-B90; A40-B91; A40-B92; A40-B93; A40-B94; A40-B95; A40-B96; A40-B97; A40-B98; A40-B99; A40-B100; A40-B101; A40-B102; A40-B103; A40-B104; A40-B105; A40-B106; A40-B107; A40-B108; A40-B109; A40-B110; A40-B111; A40-B112; A40-B113;

A41-B1; A41-B2; A41-B3; A41-B4; A41-B5; A41-B6; A41-B7; A41-B8; A41-B9; A41-B10; A41-B11; A41-B12; A41-B13; A41-B14; A41-B15; A41-B16; A41-B17; A41-B18; A41-B19; A41-B20; A41-B21; A41-B22; A41-B23; A41-B24; A41-B25; A41-B26; A41-B27; A41-B28; A41-B29; A41-B30; A41-B31; A41-B32; A41-B33; A41-B34; A41-B35; A41-B36; A41-B37; A41-B38; A41-B39; A41-B40; A41-B41; A41-B42; A41-B43; A41-B44; A41-B45; A41-B46; A41-B47; A41-B48; A41-B49; A41-B50; A41-B51; A41-B52; A41-B53; A41-B54; A41-B55; A41-B56; A41-B57; A41-B58; A41-B59; A41-B60; A41-B61; A41-B62; A41-B63; A41-B64; A41-B65; A41-B66; A41-B67; A41-B68; A41-B69; A41-B70; A41-B71; A41-B72; A41-B73; A41-B74; A41-B75; A41-B76; A41-B77; A41-B78; A41-B79; A41-B80; A41-B81; A41-B82; A41-B83; A41-B84; A41-B85; A41-B86; A41-B87; A41-B88; A41-B89; A41-B90; A41-B91; A41-B92; A41-B93; A41-B94; A41-B95; A41-B96; A41-B97; A41-B98; A41-B99; A41-B100; A41-B101; A41-B102; A41-B103; A41-B104; A41-B105; A41-B106; A41-B107; A41-B108; A41-B109; A41-B110; A41-B111; A41-B112; A41-B113;

A42-B1; A42-B2; A42-B3; A42-B4; A42-B5; A42-B6; A42-B7; A42-B8; A42-B9; A42-B10; A42-B11; A42-B12; A42-B13; A42-B14; A42-B15; A42-B16; A42-B17; A42-B18; A42-B19; A42-B20; A42-B21; A42-B22; A42-B23; A42-B24; A42-B25; A42-B26; A42-B27; A42-B28; A42-B29; A42-B30; A42-B31; A42-B32; A42-B33; A42-B34; A42-B35; A42-B36; A42-B37; A42-B38; A42-B39; A42-B40; A42-B41; A42-B42; A42-B43; A42-B44; A42-B45; A42-B46; A42-B47; A42-B48; A42-B49; A42-B50; A42-B51; A42-B52; A42-B53; A42-B54; A42-B55; A42-B56; A42-B57; A42-B58; A42-B59; A42-B60; A42-B61; A42-B62; A42-B63; A42-B64; A42-B65; A42-B66; A42-B67; A42-B68; A42-B69; A42-B70; A42-B71; A42-B72; A42-B73; A42-B74; A42-B75; A42-B76; A42-B77; A42-B78; A42-B79; A42-B80; A42-B81; A42-B82; A42-B83; A42-B84; A42-B85; A42-B86; A42-B87; A42-B88; A42-B89; A42-B90; A42-B91; A42-B92; A42-B93; A42-B94; A42-B95; A42-B96; A42-B97; A42-B98; A42-B99; A42-B100; A42-B101; A42-B102; A42-B103; A42-B104; A42-B105; A42-B106; A42-B107; A42-B108; A42-B109; A42-B110; A42-B111; A42-B112; A42-B113;

A43-B1; A43-B2; A43-B3; A43-B4; A43-B5; A43-B6; A43-B7; A43-B8; A43-B9; A43-B10; A43-B11; A43-B12;

A43-B13; A43-B14; A43-B15; A43-B16; A43-B17; A43-B18; A43-B19; A43-B20; A43-B21; A43-B22; A43-B23; A43-B24; A43-B25; A43-B26; A43-B27; A43-B28; A43-B29; A43-B30; A43-B31; A43-B32; A43-B33; A43-B34; A43-B35; A43-B36; A43-B37; A43-B38; A43-B39; A43-B40; A43-B41; A43-B42; A43-B43; A43-B44; A43-B45; A43-B46; A43-B47; A43-B48; A43-B49; A43-B50; A43-B51; A43-B52; A43-B53; A43-B54; A43-B55; A43-B56; A43-B57; A43-B58; A43-B59; A43-B60; A43-B61; A43-B62; A43-B63; A43-B64; A43-B65; A43-B66; A43-B67; A43-B68; A43-B69; A43-B70; A43-B71; A43-B72; A43-B73; A43-B74; A43-B75; A43-B76; A43-B77; A43-B78; A43-B79; A43-B80; A43-B81; A43-B82; A43-B83; A43-B84; A43-B85; A43-B86; A43-B87; A43-B88; A43-B89; A43-B90; A43-B91; A43-B92; A43-B93; A43-B94; A43-B95; A43-B96; A43-B97; A43-B98; A43-B99; A43-B100; A43-B101; A43-B102; A43-B103; A43-B104; A43-B105; A43-B106; A43-B107; A43-B108; A43-B109; A43-B110; A43-B111; A43-B112; A43-B113;

A44-B1; A44-B2; A44-B3; A44-B4; A44-B5; A44-B6; A44-B7; A44-B8; A44-B9; A44-B10; A44-B11; A44-B12; A44-B13; A44-B14; A44-B15; A44-B16; A44-B17; A44-B18; A44-B19; A44-B20; A44-B21; A44-B22; A44-B23; A44-B24; A44-B25; A44-B26; A44-B27; A44-B28; A44-B29; A44-B30; A44-B31; A44-B32; A44-B33; A44-B34; A44-B35; A44-B36; A44-B37; A44-B38; A44-B39; A44-B40; A44-B41; A44-B42; A44-B43; A44-B44; A44-B45; A44-B46; A44-B47; A44-B48; A44-B49; A44-B50; A44-B51; A44-B52; A44-B53; A44-B54; A44-B55; A44-B56; A44-B57; A44-B58; A44-B59; A44-B60; A44-B61; A44-B62; A44-B63; A44-B64; A44-B65; A44-B66; A44-B67; A44-B68; A44-B69; A44-B70; A44-B71; A44-B72; A44-B73; A44-B74; A44-B75; A44-B76; A44-B77; A44-B78; A44-B79; A44-B80; A44-B81; A44-B82; A44-B83; A44-B84; A44-B85; A44-B86; A44-B87; A44-B88; A44-B89; A44-B90; A44-B91; A44-B92; A44-B93; A44-B94; A44-B95; A44-B96; A44-B97; A44-B98; A44-B99; A44-B100; A44-B101; A44-B102; A44-B103; A44-B104; A44-B105; A44-B106; A44-B107; A44-B108; A44-B109; A44-B110; A44-B111; A44-B112; A44-B113;

A45-B1; A45-B2; A45-B3; A45-B4; A45-B5; A45-B6; A45-B7; A45-B8; A45-B9; A45-B10; A45-B11; A45-B12; A45-B13; A45-B14; A45-B15; A45-B16; A45-B17; A45-B18; A45-B19; A45-B20; A45-B21; A45-B22; A45-B23; A45-B24; A45-B25; A45-B26; A45-B27; A45-B28; A45-B29; A45-B30; A45-B31; A45-B32; A45-B33; A45-B34; A45-B35; A45-B36; A45-B37; A45-B38; A45-B39; A45-B40; A45-B41; A45-B42; A45-B43; A45-B44; A45-B45; A45-B46; A45-B47; A45-B48; A45-B49; A45-B50; A45-B51; A45-B52; A45-B53; A45-B54; A45-B55; A45-B56; A45-B57; A45-B58; A45-B59; A45-B60; A45-B61; A45-B62; A45-B63; A45-B64; A45-B65; A45-B66; A45-B67; A45-B68; A45-B69; A45-B70; A45-B71; A45-B72; A45-B73; A45-B74; A45-B75; A45-B76; A45-B77; A45-B78; A45-B79; A45-B80; A45-B81; A45-B82; A45-B83; A45-B84; A45-B85; A45-B86; A45-B87; A45-B88; A45-B89; A45-B90; A45-B91; A45-B92; A45-B93; A45-B94; A45-B95; A45-B96; A45-B97; A45-B98; A45-B99; A45-B100; A45-B101; A45-B102; A45-B103; A45-B104; A45-B105; A45-B106; A45-B107; A45-B108; A45-B109; A45-B110; A45-B111; A45-B112; A45-B113;

A46-B1; A46-B2; A46-B3; A46-B4; A46-B5; A46-B6; A46-B7; A46-B8; A46-B9; A46-B10; A46-B11; A46-B12; A46-B13; A46-B14; A46-B15; A46-B16; A46-B17; A46-B18; A46-B19; A46-B20; A46-B21; A46-B22; A46-B23; A46-B24; A46-B25; A46-B26; A46-B27; A46-B28; A46-B29; A46-B30; A46-B31; A46-B32; A46-B33; A46-B34; A46-B35; A46-B36; A46-B37; A46-B38; A46-B39; A46-B40; A46-B41; A46-B42; A46-B43; A46-B44; A46-B45; A46-B46; A46-B47; A46-B48; A46-B49; A46-B50; A46-B51; A46-B52; A46-B53; A46-B54; A46-B55; A46-B56; A46-B57; A46-B58; A46-B59; A46-B60; A46-B61; A46-B62; A46-B63; A46-B64; A46-B65; A46-B66; A46-B67; A46-B68; A46-B69; A46-B70; A46-B71; A46-B72; A46-B73; A46-B74; A46-B75; A46-B76; A46-B77; A46-B78; A46-B79; A46-B80; A46-B81; A46-B82; A46-B83; A46-B84; A46-B85; A46-B86; A46-B87; A46-B88; A46-B89; A46-B90; A46-B91; A46-B92; A46-B93; A46-B94; A46-B95; A46-B96; A46-B97; A46-B98; A46-B99; A46-B100; A46-B101; A46-B102; A46-B103; A46-B104; A46-B105; A46-B106; A46-B107; A46-B108; A46-B109; A46-B110; A46-B111; A46-B112; A46-B113;

A47-B1; A47-B2; A47-B3; A47-B4; A47-B5; A47-B6; A47-B7; A47-B8; A47-B9; A47-B10; A47-B11; A47-B12; A47-B13; A47-B14; A47-B15; A47-B16; A47-B17; A47-B18; A47-B19; A47-B20; A47-B21; A47-B22; A47-B23; A47-B24; A47-B25; A47-B26; A47-B27; A47-B28; A47-B29; A47-B30; A47-B31; A47-B32; A47-B33; A47-B34; A47-B35; A47-B36; A47-B37; A47-B38; A47-B39; A47-B40; A47-B41; A47-B42; A47-B43; A47-B44; A47-B45; A47-B46; A47-B47; A47-B48; A47-B49; A47-B50; A47-B51; A47-B52; A47-B53; A47-B54; A47-B55; A47-B56; A47-B57; A47-B58; A47-B59; A47-B60; A47-B61; A47-B62; A47-B63; A47-B64; A47-B65; A47-B66; A47-B67; A47-B68; A47-B69; A47-B70; A47-B71; A47-B72; A47-B73; A47-B74; A47-B75; A47-B76; A47-B77; A47-B78; A47-B79; A47-B80; A47-B81; A47-B82; A47-B83; A47-B84; A47-B85; A47-B86; A47-B87; A47-B88; A47-B89; A47-B90; A47-B91; A47-B92; A47-B93; A47-B94; A47-B95; A47-B96; A47-B97; A47-B98; A47-B99; A47-B100; A47-B101; A47-B102; A47-B103; A47-B104; A47-B105; A47-B106; A47-B107; A47-B108; A47-B109; A47-B110; A47-B111; A47-B112; A47-B113;

A48-B1; A48-B2; A48-B3; A48-B4; A48-B5; A48-B6; A48-B7; A48-B8; A48-B9; A48-B10; A48-B11; A48-B12; A48-B13; A48-B14; A48-B15; A48-B16; A48-B17; A48-B18; A48-B19; A48-B20; A48-B21; A48-B22; A48-B23; A48-B24; A48-B25; A48-B26; A48-B27; A48-B28; A48-B29; A48-B30; A48-B31; A48-B32; A48-B33; A48-B34; A48-B35; A48-B36; A48-B37; A48-B38; A48-B39; A48-B40; A48-B41; A48-B42; A48-B43; A48-B44; A48-B45; A48-B46; A48-B47; A48-B48; A48-B49; A48-B50; A48-B51; A48-B52; A48-B53; A48-B54; A48-B55; A48-B56; A48-B57; A48-B58; A48-B59; A48-B60; A48-B61; A48-B62; A48-B63; A48-B64; A48-B65; A48-B66; A48-B67; A48-B68; A48-B69; A48-B70; A48-B71; A48-B72; A48-B73; A48-B74; A48-B75; A48-B76; A48-B77; A48-B78; A48-B79; A48-B80; A48-B81; A48-B82; A48-B83; A48-B84; A48-B85; A48-B86; A48-B87; A48-B88; A48-B89; A48-B90; A48-B91; A48-B92; A48-B93; A48-B94; A48-B95; A48-B96; A48-B97; A48-B98; A48-B99; A48-B100; A48-B101; A48-B102; A48-B103; A48-B104; A48-B105; A48-B106; A48-B107; A48-B108; A48-B109; A48-B110; A48-B111; A48-B112; A48-B113;

A49-B1; A49-B2; A49-B3; A49-B4; A49-B5; A49-B6; A49-B7; A49-B8; A49-B9; A49-B10; A49-B11; A49-B12; A49-B13; A49-B14; A49-B15; A49-B16; A49-B17; A49-B18; A49-B19; A49-B20; A49-B21; A49-B22; A49-B23; A49-B24; A49-B25; A49-B26; A49-B27; A49-B28; A49-B29; A49-B30; A49-B31; A49-B32; A49-B33; A49-B34; A49-B35; A49-B36; A49-B37; A49-B38; A49-B39; A49-B40; A49-B41; A49-B42; A49-B43; A49-B44; A49-B45; A49-B46; A49-B47; A49-B48; A49-B49; A49-B50; A49-B51; A49-B52; A49-B53; A49-B54; A49-B55; A49-B56;

A49-B57; A49-B58; A49-B59; A49-B60; A49-B61; A49-B62; A49-B63; A49-B64; A49-B65; A49-B66; A49-B67; A49-B68; A49-B69; A49-B70; A49-B71; A49-B72; A49-B73; A49-B74; A49-B75; A49-B76; A49-B77; A49-B78; A49-B79; A49-B80; A49-B81; A49-B82; A49-B83; A49-B84; A49-B85; A49-B86; A49-B87; A49-B88; A49-B89; A49-B90; A49-B91; A49-B92; A49-B93; A49-B94; A49-B95; A49-B96; A49-B97; A49-B98; A49-B99; A49-B100; A49-B101; A49-B102; A49-B103; A49-B104; A49-B105; A49-B106; A49-B107; A49-B108; A49-B109; A49-B110; A49-B111; A49-B112; A49-B113;

A50-B1; A50-B2; A50-B3; A50-B4; A50-B5; A50-B6; A50-B7; A50-B8; A50-B9; A50-B10; A50-B11; A50-B12; A50-B13; A50-B14; A50-B15; A50-B16; A50-B17; A50-B18; A50-B19; A50-B20; A50-B21; A50-B22; A50-B23; A50-B24; A50-B25; A50-B26; A50-B27; A50-B28; A50-B29; A50-B30; A50-B31; A50-B32; A50-B33; A50-B34; A50-B35; A50-B36; A50-B37; A50-B38; A50-B39; A50-B40; A50-B41; A50-B42; A50-B43; A50-B44; A50-B45; A50-B46; A50-B47; A50-B48; A50-B49; A50-B50; A50-B51; A50-B52; A50-B53; A50-B54; A50-B55; A50-B56; A50-B57; A50-B58; A50-B59; A50-B60; A50-B61; A50-B62; A50-B63; A50-B64; A50-B65; A50-B66; A50-B67; A50-B68; A50-B69; A50-B70; A50-B71; A50-B72; A50-B73; A50-B74; A50-B75; A50-B76; A50-B77; A50-B78; A50-B79; A50-B80; A50-B81; A50-B82; A50-B83; A50-B84; A50-B85; A50-B86; A50-B87; A50-B88; A50-B89; A50-B90; A50-B91; A50-B92; A50-B93; A50-B94; A50-B95; A50-B96; A50-B97; A50-B98; A50-B99; A50-B100; A50-B101; A50-B102; A50-B103; A50-B104; A50-B105; A50-B106; A50-B107; A50-B108; A50-B109; A50-B110; A50-B111; A50-B112; A50-B113;

A51-B1; A51-B2; A51-B3; A51-B4; A51-B5; A51-B6; A51-B7; A51-B8; A51-B9; A51-B10; A51-B11; A51-B12; A51-B13; A51-B14; A51-B15; A51-B16; A51-B17; A51-B18; A51-B19; A51-B20; A51-B21; A51-B22; A51-B23; A51-B24; A51-B25; A51-B26; A51-B27; A51-B28; A51-B29; A51-B30; A51-B31; A51-B32; A51-B33; A51-B34; A51-B35; A51-B36; A51-B37; A51-B38; A51-B39; A51-B40; A51-B41; A51-B42; A51-B43; A51-B44; A51-B45; A51-B46; A51-B47; A51-B48; A51-B49; A51-B50; A51-B51; A51-B52; A51-B53; A51-B54; A51-B55; A51-B56; A51-B57; A51-B58; A51-B59; A51-B60; A51-B61; A51-B62; A51-B63; A51-B64; A51-B65; A51-B66; A51-B67; A51-B68; A51-B69; A51-B70; A51-B71; A51-B72; A51-B73; A51-B74; A51-B75; A51-B76; A51-B77; A51-B78; A51-B79; A51-B80; A51-B81; A51-B82; A51-B83; A51-B84; A51-B85; A51-B86; A51-B87; A51-B88; A51-B89; A51-B90; A51-B91; A51-B92; A51-B93; A51-B94; A51-B95; A51-B96; A51-B97; A51-B98; A51-B99; A51-B100; A51-B101; A51-B102; A51-B103; A51-B104; A51-B105; A51-B106; A51-B107; A51-B108; A51-B109; A51-B110; A51-B111; A51-B112; A51-B113;

A52-B1; A52-B2; A52-B3; A52-B4; A52-B5; A52-B6; A52-B7; A52-B8; A52-B9; A52-B10; A52-B11; A52-B12; A52-B13; A52-B14; A52-B15; A52-B16; A52-B17; A52-B18; A52-B19; A52-B20; A52-B21; A52-B22; A52-B23; A52-B24; A52-B25; A52-B26; A52-B27; A52-B28; A52-B29; A52-B30; A52-B31; A52-B32; A52-B33; A52-B34; A52-B35; A52-B36; A52-B37; A52-B38; A52-B39; A52-B40; A52-B41; A52-B42; A52-B43; A52-B44; A52-B45; A52-B46; A52-B47; A52-B48; A52-B49; A52-B50; A52-B51; A52-B52; A52-B53; A52-B54; A52-B55; A52-B56; A52-B57; A52-B58; A52-B59; A52-B60; A52-B61; A52-B62; A52-B63; A52-B64; A52-B65; A52-B66; A52-B67; A52-B68; A52-B69; A52-B70; A52-B71; A52-B72; A52-B73; A52-B74; A52-B75; A52-B76; A52-B77; A52-B78; A52-B79; A52-B80; A52-B81; A52-B82; A52-B83; A52-B84; A52-B85; A52-B86; A52-B87; A52-B88; A52-B89; A52-B90; A52-B91; A52-B92; A52-B93; A52-B94; A52-B95; A52-B96; A52-B97; A52-B98; A52-B99; A52-B100; A52-B101; A52-B102; A52-B103; A52-B104; A52-B105; A52-B106; A52-B107; A52-B108; A52-B109; A52-B110; A52-B111; A52-B112; A52-B113;

A53-B1; A53-B2; A53-B3; A53-B4; A53-B5; A53-B6; A53-B7; A53-B8; A53-B9; A53-B10; A53-B11; A53-B12; A53-B13; A53-B14; A53-B15; A53-B16; A53-B17; A53-B18; A53-B19; A53-B20; A53-B21; A53-B22; A53-B23; A53-B24; A53-B25; A53-B26; A53-B27; A53-B28; A53-B29; A53-B30; A53-B31; A53-B32; A53-B33; A53-B34; A53-B35; A53-B36; A53-B37; A53-B38; A53-B39; A53-B40; A53-B41; A53-B42; A53-B43; A53-B44; A53-B45; A53-B46; A53-B47; A53-B48; A53-B49; A53-B50; A53-B51; A53-B52; A53-B53; A53-B54; A53-B55; A53-B56; A53-B57; A53-B58; A53-B59; A53-B60; A53-B61; A53-B62; A53-B63; A53-B64; A53-B65; A53-B66; A53-B67; A53-B68; A53-B69; A53-B70; A53-B71; A53-B72; A53-B73; A53-B74; A53-B75; A53-B76; A53-B77; A53-B78; A53-B79; A53-B80; A53-B81; A53-B82; A53-B83; A53-B84; A53-B85; A53-B86; A53-B87; A53-B88; A53-B89; A53-B90; A53-B91; A53-B92; A53-B93; A53-B94; A53-B95; A53-B96; A53-B97; A53-B98; A53-B99; A53-B100; A53-B101; A53-B102; A53-B103; A53-B104; A53-B105; A53-B106; A53-B107; A53-B108; A53-B109; A53-B110; A53-B111; A53-B112; A53-B113;

A54-B1; A54-B2; A54-B3; A54-B4; A54-B5; A54-B6; A54-B7; A54-B8; A54-B9; A54-B10; A54-B11; A54-B12; A54-B13; A54-B14; A54-B15; A54-B16; A54-B17; A54-B18; A54-B19; A54-B20; A54-B21; A54-B22; A54-B23; A54-B24; A54-B25; A54-B26; A54-B27; A54-B28; A54-B29; A54-B30; A54-B31; A54-B32; A54-B33; A54-B34; A54-B35; A54-B36; A54-B37; A54-B38; A54-B39; A54-B40; A54-B41; A54-B42; A54-B43; A54-B44; A54-B45; A54-B46; A54-B47; A54-B48; A54-B49; A54-B50; A54-B51; A54-B52; A54-B53; A54-B54; A54-B55; A54-B56; A54-B57; A54-B58; A54-B59; A54-B60; A54-B61; A54-B62; A54-B63; A54-B64; A54-B65; A54-B66; A54-B67; A54-B68; A54-B69; A54-B70; A54-B71; A54-B72; A54-B73; A54-B74; A54-B75; A54-B76; A54-B77; A54-B78; A54-B79; A54-B80; A54-B81; A54-B82; A54-B83; A54-B84; A54-B85; A54-B86; A54-B87; A54-B88; A54-B89; A54-B90; A54-B91; A54-B92; A54-B93; A54-B94; A54-B95; A54-B96; A54-B97; A54-B98; A54-B99; A54-B100; A54-B101; A54-B102; A54-B103; A54-B104; A54-B105; A54-B106; A54-B107; A54-B108; A54-B109; A54-B110; A54-B111; A54-B112; A54-B113;

A55-B1; A55-B2; A55-B3; A55-B4; A55-B5; A55-B6; A55-B7; A55-B8; A55-B9; A55-B10; A55-B11; A55-B12; A55-B13; A55-B14; A55-B15; A55-B16; A55-B17; A55-B18; A55-B19; A55-B20; A55-B21; A55-B22; A55-B23; A55-B24; A55-B25; A55-B26; A55-B27; A55-B28; A55-B29; A55-B30; A55-B31; A55-B32; A55-B33; A55-B34; A55-B35; A55-B36; A55-B37; A55-B38; A55-B39; A55-B40; A55-B41; A55-B42; A55-B43; A55-B44; A55-B45; A55-B46; A55-B47; A55-B48; A55-B49; A55-B50; A55-B51; A55-B52; A55-B53; A55-B54; A55-B55; A55-B56; A55-B57; A55-B58; A55-B59; A55-B60; A55-B61; A55-B62; A55-B63; A55-B64; A55-B65; A55-B66; A55-B67; A55-B68; A55-B69; A55-B70; A55-B71; A55-B72; A55-B73; A55-B74; A55-B75; A55-B76; A55-B77; A55-B78; A55-B79; A55-B80; A55-B81; A55-B82; A55-B83; A55-B84; A55-B85; A55-B86; A55-B87; A55-B88; A55-B89; A55-B90; A55-B91; A55-B92; A55-B93; A55-B94; A55-B95; A55-B96; A55-B97; A55-B98; A55-B99; A55-B100;

A55-B101; A55-B102; A55-B103; A55-B104; A55-B105; A55-B106; A55-B107; A55-B108; A55-B109; A55-B110; A55-B111; A55-B112; A55-B113;

A56-B1; A56-B2; A56-B3; A56-B4; A56-B5; A56-B6; A56-B7; A56-B8; A56-B9; A56-B10; A56-B11; A56-B12; A56-B13; A56-B14; A56-B15; A56-B16; A56-B17; A56-B18; A56-B19; A56-B20; A56-B21; A56-B22; A56-B23; A56-B24; A56-B25; A56-B26; A56-B27; A56-B28; A56-B29; A56-B30; A56-B31; A56-B32; A56-B33; A56-B34; A56-B35; A56-B36; A56-B37; A56-B38; A56-B39; A56-B40; A56-B41; A56-B42; A56-B43; A56-B44; A56-B45; A56-B46; A56-B47; A56-B48; A56-B49; A56-B50; A56-B51; A56-B52; A56-B53; A56-B54; A56-B55; A56-B56; A56-B57; A56-B58; A56-B59; A56-B60; A56-B61; A56-B62; A56-B63; A56-B64; A56-B65; A56-B66; A56-B67; A56-B68; A56-B69; A56-B70; A56-B71; A56-B72; A56-B73; A56-B74; A56-B75; A56-B76; A56-B77; A56-B78; A56-B79; A56-B80; A56-B81; A56-B82; A56-B83; A56-B84; A56-B85; A56-B86; A56-B87; A56-B88; A56-B89; A56-B90; A56-B91; A56-B92; A56-B93; A56-B94; A56-B95; A56-B96; A56-B97; A56-B98; A56-B99; A56-B100; A56-B101; A56-B102; A56-B103; A56-B104; A56-B105; A56-B106; A56-B107; A56-B108; A56-B109; A56-B110; A56-B111; A56-B112; A56-B113;

A57-B1; A57-B2; A57-B3; A57-B4; A57-B5; A57-B6; A57-B7; A57-B8; A57-B9; A57-B10; A57-B11; A57-B12; A57-B13; A57-B14; A57-B15; A57-B16; A57-B17; A57-B18; A57-B19; A57-B20; A57-B21; A57-B22; A57-B23; A57-B24; A57-B25; A57-B26; A57-B27; A57-B28; A57-B29; A57-B30; A57-B31; A57-B32; A57-B33; A57-B34; A57-B35; A57-B36; A57-B37; A57-B38; A57-B39; A57-B40; A57-B41; A57-B42; A57-B43; A57-B44; A57-B45; A57-B46; A57-B47; A57-B48; A57-B49; A57-B50; A57-B51; A57-B52; A57-B53; A57-B54; A57-B55; A57-B56; A57-B57; A57-B58; A57-B59; A57-B60; A57-B61; A57-B62; A57-B63; A57-B64; A57-B65; A57-B66; A57-B67; A57-B68; A57-B69; A57-B70; A57-B71; A57-B72; A57-B73; A57-B74; A57-B75; A57-B76; A57-B77; A57-B78; A57-B79; A57-B80; A57-B81; A57-B82; A57-B83; A57-B84; A57-B85; A57-B86; A57-B87; A57-B88; A57-B89; A57-B90; A57-B91; A57-B92; A57-B93; A57-B94; A57-B95; A57-B96; A57-B97; A57-B98; A57-B99; A57-B100; A57-B101; A57-B102; A57-B103; A57-B104; A57-B105; A57-B106; A57-B107; A57-B108; A57-B109; A57-B110; A57-B111; A57-B112; A57-B113;

A58-B1; A58-B2; A58-B3; A58-B4; A58-B5; A58-B6; A58-B7; A58-B8; A58-B9; A58-B10; A58-B11; A58-B12; A58-B13; A58-B14; A58-B15; A58-B16; A58-B17; A58-B18; A58-B19; A58-B20; A58-B21; A58-B22; A58-B23; A58-B24; A58-B25; A58-B26; A58-B27; A58-B28; A58-B29; A58-B30; A58-B31; A58-B32; A58-B33; A58-B34; A58-B35; A58-B36; A58-B37; A58-B38; A58-B39; A58-B40; A58-B41; A58-B42; A58-B43; A58-B44; A58-B45; A58-B46; A58-B47; A58-B48; A58-B49; A58-B50; A58-B51; A58-B52; A58-B53; A58-B54; A58-B55; A58-B56; A58-B57; A58-B58; A58-B59; A58-B60; A58-B61; A58-B62; A58-B63; A58-B64; A58-B65; A58-B66; A58-B67; A58-B68; A58-B69; A58-B70; A58-B71; A58-B72; A58-B73; A58-B74; A58-B75; A58-B76; A58-B77; A58-B78; A58-B79; A58-B80; A58-B81; A58-B82; A58-B83; A58-B84; A58-B85; A58-B86; A58-B87; A58-B88; A58-B89; A58-B90; A58-B91; A58-B92; A58-B93; A58-B94; A58-B95; A58-B96; A58-B97; A58-B98; A58-B99; A58-B100; A58-B101; A58-B102; A58-B103; A58-B104; A58-B105; A58-B106; A58-B107; A58-B108; A58-B109; A58-B110; A58-B111; A58-B112; A58-B113;

A59-B1; A59-B2; A59-B3; A59-B4; A59-B5; A59-B6; A59-B7; A59-B8; A59-B9; A59-B10; A59-B11; A59-B12; A59-B13; A59-B14; A59-B15; A59-B16; A59-B17; A59-B18; A59-B19; A59-B20; A59-B21; A59-B22; A59-B23; A59-B24; A59-B25; A59-B26; A59-B27; A59-B28; A59-B29; A59-B30; A59-B31; A59-B32; A59-B33; A59-B34; A59-B35; A59-B36; A59-B37; A59-B38; A59-B39; A59-B40; A59-B41; A59-B42; A59-B43; A59-B44; A59-B45; A59-B46; A59-B47; A59-B48; A59-B49; A59-B50; A59-B51; A59-B52; A59-B53; A59-B54; A59-B55; A59-B56; A59-B57; A59-B58; A59-B59; A59-B60; A59-B61; A59-B62; A59-B63; A59-B64; A59-B65; A59-B66; A59-B67; A59-B68; A59-B69; A59-B70; A59-B71; A59-B72; A59-B73; A59-B74; A59-B75; A59-B76; A59-B77; A59-B78; A59-B79; A59-B80; A59-B81; A59-B82; A59-B83; A59-B84; A59-B85; A59-B86; A59-B87; A59-B88; A59-B89; A59-B90; A59-B91; A59-B92; A59-B93; A59-B94; A59-B95; A59-B96; A59-B97; A59-B98; A59-B99; A59-B100; A59-B101; A59-B102; A59-B103; A59-B104; A59-B105; A59-B106; A59-B107; A59-B108; A59-B109; A59-B110; A59-B111; A59-B112; A59-B113;

A60-B1; A60-B2; A60-B3; A60-B4; A60-B5; A60-B6; A60-B7; A60-B8; A60-B9; A60-B10; A60-B11; A60-B12; A60-B13; A60-B14; A60-B15; A60-B16; A60-B17; A60-B18; A60-B19; A60-B20; A60-B21; A60-B22; A60-B23; A60-B24; A60-B25; A60-B26; A60-B27; A60-B28; A60-B29; A60-B30; A60-B31; A60-B32; A60-B33; A60-B34; A60-B35; A60-B36; A60-B37; A60-B38; A60-B39; A60-B40; A60-B41; A60-B42; A60-B43; A60-B44; A60-B45; A60-B46; A60-B47; A60-B48; A60-B49; A60-B50; A60-B51; A60-B52; A60-B53; A60-B54; A60-B55; A60-B56; A60-B57; A60-B58; A60-B59; A60-B60; A60-B61; A60-B62; A60-B63; A60-B64; A60-B65; A60-B66; A60-B67; A60-B68; A60-B69; A60-B70; A60-B71; A60-B72; A60-B73; A60-B74; A60-B75; A60-B76; A60-B77; A60-B78; A60-B79; A60-B80; A60-B81; A60-B82; A60-B83; A60-B84; A60-B85; A60-B86; A60-B87; A60-B88; A60-B89; A60-B90; A60-B91; A60-B92; A60-B93; A60-B94; A60-B95; A60-B96; A60-B97; A60-B98; A60-B99; A60-B100; A60-B101; A60-B102; A60-B103; A60-B104; A60-B105; A60-B106; A60-B107; A60-B108; A60-B109; A60-B110; A60-B111; A60-B112; A60-B113;

A61-B1; A61-B2; A61-B3; A61-B4; A61-B5; A61-B6; A61-B7; A61-B8; A61-B9; A61-B10; A61-B11; A61-B12; A61-B13; A61-B14; A61-B15; A61-B16; A61-B17; A61-B18; A61-B19; A61-B20; A61-B21; A61-B22; A61-B23; A61-B24; A61-B25; A61-B26; A61-B27; A61-B28; A61-B29; A61-B30; A61-B31; A61-B32; A61-B33; A61-B34; A61-B35; A61-B36; A61-B37; A61-B38; A61-B39; A61-B40; A61-B41; A61-B42; A61-B43; A61-B44; A61-B45; A61-B46; A61-B47; A61-B48; A61-B49; A61-B50; A61-B51; A61-B52; A61-B53; A61-B54; A61-B55; A61-B56; A61-B57; A61-B58; A61-B59; A61-B60; A61-B61; A61-B62; A61-B63; A61-B64; A61-B65; A61-B66; A61-B67; A61-B68; A61-B69; A61-B70; A61-B71; A61-B72; A61-B73; A61-B74; A61-B75; A61-B76; A61-B77; A61-B78; A61-B79; A61-B80; A61-B81; A61-B82; A61-B83; A61-B84; A61-B85; A61-B86; A61-B87; A61-B88; A61-B89; A61-B90; A61-B91; A61-B92; A61-B93; A61-B94; A61-B95; A61-B96; A61-B97; A61-B98; A61-B99; A61-B100; A61-B101; A61-B102; A61-B103; A61-B104; A61-B105; A61-B106; A61-B107; A61-B108; A61-B109; A61-B110; A61-B111; A61-B112; A61-B113;

A62-B1; A62-B2; A62-B3; A62-B4; A62-B5; A62-B6; A62-B7; A62-B8; A62-B9; A62-B10; A62-B11; A62-B12; A62-B13; A62-B14; A62-B15; A62-B16; A62-B17; A62-B18; A62-B19; A62-B20; A62-B21; A62-B22; A62-B23;

A62-B24; A62-B25; A62-B26; A62-B27; A62-B28; A62-B29; A62-B30; A62-B31; A62-B32; A62-B33; A62-B34; A62-B35; A62-B36; A62-B37; A62-B38; A62-B39; A62-B40; A62-B41; A62-B42; A62-B43; A62-B44; A62-B45; A62-B46; A62-B47; A62-B48; A62-B49; A62-B50; A62-B51; A62-B52; A62-B53; A62-B54; A62-B55; A62-B56; A62-B57; A62-B58; A62-B59; A62-B60; A62-B61; A62-B62; A62-B63; A62-B64; A62-B65; A62-B66; A62-B67; A62-B68; A62-B69; A62-B70; A62-B71; A62-B72; A62-B73; A62-B74; A62-B75; A62-B76; A62-B77; A62-B78; A62-B79; A62-B80; A62-B81; A62-B82; A62-B83; A62-B84; A62-B85; A62-B86; A62-B87; A62-B88; A62-B89; A62-B90; A62-B91; A62-B92; A62-B93; A62-B94; A62-B95; A62-B96; A62-B97; A62-B98; A62-B99; A62-B100; A62-B101; A62-B102; A62-B103; A62-B104; A62-B105; A62-B106; A62-B107; A62-B108; A62-B109; A62-B110; A62-B111; A62-B112; A62-B113;

A63-B1; A63-B2; A63-B3; A63-B4; A63-B5; A63-B6; A63-B7; A63-B8; A63-B9; A63-B10; A63-B11; A63-B12; A63-B13; A63-B14; A63-B15; A63-B16; A63-B17; A63-B18; A63-B19; A63-B20; A63-B21; A63-B22; A63-B23; A63-B24; A63-B25; A63-B26; A63-B27; A63-B28; A63-B29; A63-B30; A63-B31; A63-B32; A63-B33; A63-B34; A63-B35; A63-B36; A63-B37; A63-B38; A63-B39; A63-B40; A63-B41; A63-B42; A63-B43; A63-B44; A63-B45; A63-B46; A63-B47; A63-B48; A63-B49; A63-B50; A63-B51; A63-B52; A63-B53; A63-B54; A63-B55; A63-B56; A63-B57; A63-B58; A63-B59; A63-B60; A63-B61; A63-B62; A63-B63; A63-B64; A63-B65; A63-B66; A63-B67; A63-B68; A63-B69; A63-B70; A63-B71; A63-B72; A63-B73; A63-B74; A63-B75; A63-B76; A63-B77; A63-B78; A63-B79; A63-B80; A63-B81; A63-B82; A63-B83; A63-B84; A63-B85; A63-B86; A63-B87; A63-B88; A63-B89; A63-B90; A63-B91; A63-B92; A63-B93; A63-B94; A63-B95; A63-B96; A63-B97; A63-B98; A63-B99; A63-B100; A63-B101; A63-B102; A63-B103; A63-B104; A63-B105; A63-B106; A63-B107; A63-B108; A63-B109; A63-B110; A63-B111; A63-B112; A63-B113;

A64-B1; A64-B2; A64-B3; A64-B4; A64-B5; A64-B6; A64-B7; A64-B8; A64-B9; A64-B10; A64-B11; A64-B12; A64-B13; A64-B14; A64-B15; A64-B16; A64-B17; A64-B18; A64-B19; A64-B20; A64-B21; A64-B22; A64-B23; A64-B24; A64-B25; A64-B26; A64-B27; A64-B28; A64-B29; A64-B30; A64-B31; A64-B32; A64-B33; A64-B34; A64-B35; A64-B36; A64-B37; A64-B38; A64-B39; A64-B40; A64-B41; A64-B42; A64-B43; A64-B44; A64-B45; A64-B46; A64-B47; A64-B48; A64-B49; A64-B50; A64-B51; A64-B52; A64-B53; A64-B54; A64-B55; A64-B56; A64-B57; A64-B58; A64-B59; A64-B60; A64-B61; A64-B62; A64-B63; A64-B64; A64-B65; A64-B66; A64-B67; A64-B68; A64-B69; A64-B70; A64-B71; A64-B72; A64-B73; A64-B74; A64-B75; A64-B76; A64-B77; A64-B78; A64-B79; A64-B80; A64-B81; A64-B82; A64-B83; A64-B84; A64-B85; A64-B86; A64-B87; A64-B88; A64-B89; A64-B90; A64-B91; A64-B92; A64-B93; A64-B94; A64-B95; A64-B96; A64-B97; A64-B98; A64-B99; A64-B100; A64-B101; A64-B102; A64-B103; A64-B104; A64-B105; A64-B106; A64-B107; A64-B108; A64-B109; A64-B110; A64-B111; A64-B112; A64-B113;

A65-B1; A65-B2; A65-B3; A65-B4; A65-B5; A65-B6; A65-B7; A65-B8; A65-B9; A65-B10; A65-B11; A65-B12; A65-B13; A65-B14; A65-B15; A65-B16; A65-B17; A65-B18; A65-B19; A65-B20; A65-B21; A65-B22; A65-B23; A65-B24; A65-B25; A65-B26; A65-B27; A65-B28; A65-B29; A65-B30; A65-B31; A65-B32; A65-B33; A65-B34; A65-B35; A65-B36; A65-B37; A65-B38; A65-B39; A65-B40; A65-B41; A65-B42; A65-B43; A65-B44; A65-B45; A65-B46; A65-B47; A65-B48; A65-B49; A65-B50; A65-B51; A65-B52; A65-B53; A65-B54; A65-B55; A65-B56; A65-B57; A65-B58; A65-B59; A65-B60; A65-B61; A65-B62; A65-B63; A65-B64; A65-B65; A65-B66; A65-B67; A65-B68; A65-B69; A65-B70; A65-B71; A65-B72; A65-B73; A65-B74; A65-B75; A65-B76; A65-B77; A65-B78; A65-B79; A65-B80; A65-B81; A65-B82; A65-B83; A65-B84; A65-B85; A65-B86; A65-B87; A65-B88; A65-B89; A65-B90; A65-B91; A65-B92; A65-B93; A65-B94; A65-B95; A65-B96; A65-B97; A65-B98; A65-B99; A65-B100; A65-B101; A65-B102; A65-B103; A65-B104; A65-B105; A65-B106; A65-B107; A65-B108; A65-B109; A65-B110; A65-B111; A65-B112; A65-B113;

A66-B1; A66-B2; A66-B3; A66-B4; A66-B5; A66-B6; A66-B7; A66-B8; A66-B9; A66-B10; A66-B11; A66-B12; A66-B13; A66-B14; A66-B15; A66-B16; A66-B17; A66-B18; A66-B19; A66-B20; A66-B21; A66-B22; A66-B23; A66-B24; A66-B25; A66-B26; A66-B27; A66-B28; A66-B29; A66-B30; A66-B31; A66-B32; A66-B33; A66-B34; A66-B35; A66-B36; A66-B37; A66-B38; A66-B39; A66-B40; A66-B41; A66-B42; A66-B43; A66-B44; A66-B45; A66-B46; A66-B47; A66-B48; A66-B49; A66-B50; A66-B51; A66-B52; A66-B53; A66-B54; A66-B55; A66-B56; A66-B57; A66-B58; A66-B59; A66-B60; A66-B61; A66-B62; A66-B63; A66-B64; A66-B65; A66-B66; A66-B67; A66-B68; A66-B69; A66-B70; A66-B71; A66-B72; A66-B73; A66-B74; A66-B75; A66-B76; A66-B77; A66-B78; A66-B79; A66-B80; A66-B81; A66-B82; A66-B83; A66-B84; A66-B85; A66-B86; A66-B87; A66-B88; A66-B89; A66-B90; A66-B91; A66-B92; A66-B93; A66-B94; A66-B95; A66-B96; A66-B97; A66-B98; A66-B99; A66-B100; A66-B101; A66-B102; A66-B103; A66-B104; A66-B105; A66-B106; A66-B107; A66-B108; A66-B109; A66-B110; A66-B111; A66-B112; A66-B113;

A67-B1; A67-B2; A67-B3; A67-B4; A67-B5; A67-B6; A67-B7; A67-B8; A67-B9; A67-B10; A67-B11; A67-B12; A67-B13; A67-B14; A67-B15; A67-B16; A67-B17; A67-B18; A67-B19; A67-B20; A67-B21; A67-B22; A67-B23; A67-B24; A67-B25; A67-B26; A67-B27; A67-B28; A67-B29; A67-B30; A67-B31; A67-B32; A67-B33; A67-B34; A67-B35; A67-B36; A67-B37; A67-B38; A67-B39; A67-B40; A67-B41; A67-B42; A67-B43; A67-B44; A67-B45; A67-B46; A67-B47; A67-B48; A67-B49; A67-B50; A67-B51; A67-B52; A67-B53; A67-B54; A67-B55; A67-B56; A67-B57; A67-B58; A67-B59; A67-B60; A67-B61; A67-B62; A67-B63; A67-B64; A67-B65; A67-B66; A67-B67; A67-B68; A67-B69; A67-B70; A67-B71; A67-B72; A67-B73; A67-B74; A67-B75; A67-B76; A67-B77; A67-B78; A67-B79; A67-B80; A67-B81; A67-B82; A67-B83; A67-B84; A67-B85; A67-B86; A67-B87; A67-B88; A67-B89; A67-B90; A67-B91; A67-B92; A67-B93; A67-B94; A67-B95; A67-B96; A67-B97; A67-B98; A67-B99; A67-B100; A67-B101; A67-B102; A67-B103; A67-B104; A67-B105; A67-B106; A67-B107; A67-B108; A67-B109; A67-B110; A67-B111; A67-B112; A67-B113;

A68-B1; A68-B2; A68-B3; A68-B4; A68-B5; A68-B6; A68-B7; A68-B8; A68-B9; A68-B10; A68-B11; A68-B12; A68-B13; A68-B14; A68-B15; A68-B16; A68-B17; A68-B18; A68-B19; A68-B20; A68-B21; A68-B22; A68-B23; A68-B24; A68-B25; A68-B26; A68-B27; A68-B28; A68-B29; A68-B30; A68-B31; A68-B32; A68-B33; A68-B34; A68-B35; A68-B36; A68-B37; A68-B38; A68-B39; A68-B40; A68-B41; A68-B42; A68-B43; A68-B44; A68-B45; A68-B46; A68-B47; A68-B48; A68-B49; A68-B50; A68-B51; A68-B52; A68-B53; A68-B54; A68-B55; A68-B56; A68-B57; A68-B58; A68-B59; A68-B60; A68-B61; A68-B62; A68-B63; A68-B64; A68-B65; A68-B66; A68-B67;

A68-B68; A68-B69; A68-B70; A68-B71; A68-B72; A68-B73; A68-B74; A68-B75; A68-B76; A68-B77; A68-B78; A68-B79; A68-B80; A68-B81; A68-B82; A68-B83; A68-B84; A68-B85; A68-B86; A68-B87; A68-B88; A68-B89; A68-B90; A68-B91; A68-B92; A68-B93; A68-B94; A68-B95; A68-B96; A68-B97; A68-B98; A68-B99; A68-B100; A68-B101; A68-B102; A68-B103; A68-B104; A68-B105; A68-B106; A68-B107; A68-B108; A68-B109; A68-B110; A68-B111; A68-B112; A68-B113;

A69-B1; A69-B2; A69-B3; A69-B4; A69-B5; A69-B6; A69-B7; A69-B8; A69-B9; A69-B10; A69-B11; A69-B12; A69-B13; A69-B14; A69-B15; A69-B16; A69-B17; A69-B18; A69-B19; A69-B20; A69-B21; A69-B22; A69-B23; A69-B24; A69-B25; A69-B26; A69-B27; A69-B28; A69-B29; A69-B30; A69-B31; A69-B32; A69-B33; A69-B34; A69-B35; A69-B36; A69-B37; A69-B38; A69-B39; A69-B40; A69-B41; A69-B42; A69-B43; A69-B44; A69-B45; A69-B46; A69-B47; A69-B48; A69-B49; A69-B50; A69-B51; A69-B52; A69-B53; A69-B54; A69-B55; A69-B56; A69-B57; A69-B58; A69-B59; A69-B60; A69-B61; A69-B62; A69-B63; A69-B64; A69-B65; A69-B66; A69-B67; A69-B68; A69-B69; A69-B70; A69-B71; A69-B72; A69-B73; A69-B74; A69-B75; A69-B76; A69-B77; A69-B78; A69-B79; A69-B80; A69-B81; A69-B82; A69-B83; A69-B84; A69-B85; A69-B86; A69-B87; A69-B88; A69-B89; A69-B90; A69-B91; A69-B92; A69-B93; A69-B94; A69-B95; A69-B96; A69-B97; A69-B98; A69-B99; A69-B100; A69-B101; A69-B102; A69-B103; A69-B104; A69-B105; A69-B106; A69-B107; A69-B108; A69-B109; A69-B110; A69-B111; A69-B112; A69-B113;

A70-B1; A70-B2; A70-B3; A70-B4; A70-B5; A70-B6; A70-B7; A70-B8; A70-B9; A70-B10; A70-B11; A70-B12; A70-B13; A70-B14; A70-B15; A70-B16; A70-B17; A70-B18; A70-B19; A70-B20; A70-B21; A70-B22; A70-B23; A70-B24; A70-B25; A70-B26; A70-B27; A70-B28; A70-B29; A70-B30; A70-B31; A70-B32; A70-B33; A70-B34; A70-B35; A70-B36; A70-B37; A70-B38; A70-B39; A70-B40; A70-B41; A70-B42; A70-B43; A70-B44; A70-B45; A70-B46; A70-B47; A70-B48; A70-B49; A70-B50; A70-B51; A70-B52; A70-B53; A70-B54; A70-B55; A70-B56; A70-B57; A70-B58; A70-B59; A70-B60; A70-B61; A70-B62; A70-B63; A70-B64; A70-B65; A70-B66; A70-B67; A70-B68; A70-B69; A70-B70; A70-B71; A70-B72; A70-B73; A70-B74; A70-B75; A70-B76; A70-B77; A70-B78; A70-B79; A70-B80; A70-B81; A70-B82; A70-B83; A70-B84; A70-B85; A70-B86; A70-B87; A70-B88; A70-B89; A70-B90; A70-B91; A70-B92; A70-B93; A70-B94; A70-B95; A70-B96; A70-B97; A70-B98; A70-B99; A70-B100; A70-B101; A70-B102; A70-B103; A70-B104; A70-B105; A70-B106; A70-B107; A70-B108; A70-B109; A70-B110; A70-B111; A70-B112; A70-B113;

A71-B1; A71-B2; A71-B3; A71-B4; A71-B5; A71-B6; A71-B7; A71-B8; A71-B9; A71-B10; A71-B11; A71-B12; A71-B13; A71-B14; A71-B15; A71-B16; A71-B17; A71-B18; A71-B19; A71-B20; A71-B21; A71-B22; A71-B23; A71-B24; A71-B25; A71-B26; A71-B27; A71-B28; A71-B29; A71-B30; A71-B31; A71-B32; A71-B33; A71-B34; A71-B35; A71-B36; A71-B37; A71-B38; A71-B39; A71-B40; A71-B41; A71-B42; A71-B43; A71-B44; A71-B45; A71-B46; A71-B47; A71-B48; A71-B49; A71-B50; A71-B51; A71-B52; A71-B53; A71-B54; A71-B55; A71-B56; A71-B57; A71-B58; A71-B59; A71-B60; A71-B61; A71-B62; A71-B63; A71-B64; A71-B65; A71-B66; A71-B67; A71-B68; A71-B69; A71-B70; A71-B71; A71-B72; A71-B73; A71-B74; A71-B75; A71-B76; A71-B77; A71-B78; A71-B79; A71-B80; A71-B81; A71-B82; A71-B83; A71-B84; A71-B85; A71-B86; A71-B87; A71-B88; A71-B89; A71-B90; A71-B91; A71-B92; A71-B93; A71-B94; A71-B95; A71-B96; A71-B97; A71-B98; A71-B99; A71-B100; A71-B101; A71-B102; A71-B103; A71-B104; A71-B105; A71-B106; A71-B107; A71-B108; A71-B109; A71-B110; A71-B111; A71-B112; A71-B113;

A72-B1; A72-B2; A72-B3; A72-B4; A72-B5; A72-B6; A72-B7; A72-B8; A72-B9; A72-B10; A72-B11; A72-B12; A72-B13; A72-B14; A72-B15; A72-B16; A72-B17; A72-B18; A72-B19; A72-B20; A72-B21; A72-B22; A72-B23; A72-B24; A72-B25; A72-B26; A72-B27; A72-B28; A72-B29; A72-B30; A72-B31; A72-B32; A72-B33; A72-B34; A72-B35; A72-B36; A72-B37; A72-B38; A72-B39; A72-B40; A72-B41; A72-B42; A72-B43; A72-B44; A72-B45; A72-B46; A72-B47; A72-B48; A72-B49; A72-B50; A72-B51; A72-B52; A72-B53; A72-B54; A72-B55; A72-B56; A72-B57; A72-B58; A72-B59; A72-B60; A72-B61; A72-B62; A72-B63; A72-B64; A72-B65; A72-B66; A72-B67; A72-B68; A72-B69; A72-B70; A72-B71; A72-B72; A72-B73; A72-B74; A72-B75; A72-B76; A72-B77; A72-B78; A72-B79; A72-B80; A72-B81; A72-B82; A72-B83; A72-B84; A72-B85; A72-B86; A72-B87; A72-B88; A72-B89; A72-B90; A72-B91; A72-B92; A72-B93; A72-B94; A72-B95; A72-B96; A72-B97; A72-B98; A72-B99; A72-B100; A72-B101; A72-B102; A72-B103; A72-B104; A72-B105; A72-B106; A72-B107; A72-B108; A72-B109; A72-B110; A72-B1111; A72-B112; A72-B113;

A73-B1; A73-B2; A73-B3; A73-B4; A73-B5; A73-B6; A73-B7; A73-B8; A73-B9; A73-B10; A73-B11; A73-B12; A73-B13; A73-B14; A73-B15; A73-B16; A73-B17; A73-B18; A73-B19; A73-B20; A73-B21; A73-B22; A73-B23; A73-B24; A73-B25; A73-B26; A73-B27; A73-B28; A73-B29; A73-B30; A73-B31; A73-B32; A73-B33; A73-B34; A73-B35; A73-B36; A73-B37; A73-B38; A73-B39; A73-B40; A73-B41; A73-B42; A73-B43; A73-B44; A73-B45; A73-B46; A73-B47; A73-B48; A73-B49; A73-B50; A73-B51; A73-B52; A73-B53; A73-B54; A73-B55; A73-B56; A73-B57; A73-B58; A73-B59; A73-B60; A73-B61; A73-B62; A73-B63; A73-B64; A73-B65; A73-B66; A73-B67; A73-B68; A73-B69; A73-B70; A73-B71; A73-B72; A73-B73; A73-B74; A73-B75; A73-B76; A73-B77; A73-B78; A73-B79; A73-B80; A73-B81; A73-B82; A73-B83; A73-B84; A73-B85; A73-B86; A73-B87; A73-B88; A73-B89; A73-B90; A73-B91; A73-B92; A73-B93; A73-B94; A73-B95; A73-B96; A73-B97; A73-B98; A73-B99; A73-B100; A73-B101; A73-B102; A73-B103; A73-B104; A73-B105; A73-B106; A73-B107; A73-B108; A73-B109; A73-B110; A73-B111; A73-B112; A73-B113;

A74-B1; A74-B2; A74-B3; A74-B4; A74-B5; A74-B6; A74-B7; A74-B8; A74-B9; A74-B10; A74-B11; A74-B12; A74-B13; A74-B14; A74-B15; A74-B16; A74-B17; A74-B18; A74-B19; A74-B20; A74-B21; A74-B22; A74-B23; A74-B24; A74-B25; A74-B26; A74-B27; A74-B28; A74-B29; A74-B30; A74-B31; A74-B32; A74-B33; A74-B34; A74-B35; A74-B36; A74-B37; A74-B38; A74-B39; A74-B40; A74-B41; A74-B42; A74-B43; A74-B44; A74-B45; A74-B46; A74-B47; A74-B48; A74-B49; A74-B50; A74-B51; A74-B52; A74-B53; A74-B54; A74-B55; A74-B56; A74-B57; A74-B58; A74-B59; A74-B60; A74-B61; A74-B62; A74-B63; A74-B64; A74-B65; A74-B66; A74-B67; A74-B68; A74-B69; A74-B70; A74-B71; A74-B72; A74-B73; A74-B74; A74-B75; A74-B76; A74-B77; A74-B78; A74-B79; A74-B80; A74-B81; A74-B82; A74-B83; A74-B84; A74-B85; A74-B86; A74-B87; A74-B88; A74-B89; A74-B90; A74-B91; A74-B92; A74-B93; A74-B94; A74-B95; A74-B96; A74-B97; A74-B98; A74-B99; A74-B100; A74-B101; A74-B102; A74-B103; A74-B104; A74-B105;

A74-B106; A74-B107; A74-B108; A74-B109; A74-B110; A74-B111; A74-B112; A74-B113;

A75-B1; A75-B2; A75-B3; A75-B4; A75-B5; A75-B6; A75-B7; A75-B8; A75-B9; A75-B10; A75-B11; A75-B12; A75-B13; A75-B14; A75-B15; A75-B16; A75-B17; A75-B18; A75-B19; A75-B20; A75-B21; A75-B22; A75-B23; A75-B24; A75-B25; A75-B26; A75-B27; A75-B28; A75-B29; A75-B30; A75-B31; A75-B32; A75-B33; A75-B34; A75-B35; A75-B36; A75-B37; A75-B38; A75-B39; A75-B40; A75-B41; A75-B42; A75-B43; A75-B44; A75-B45; A75-B46; A75-B47; A75-B48; A75-B49; A75-B50; A75-B51; A75-B52; A75-B53; A75-B54; A75-B55; A75-B56; A75-B57; A75-B58; A75-B59; A75-B60; A75-B61; A75-B62; A75-B63; A75-B64; A75-B65; A75-B66; A75-B67; A75-B68; A75-B69; A75-B70; A75-B71; A75-B72; A75-B73; A75-B74; A75-B75; A75-B76; A75-B77; A75-B78; A75-B79; A75-B80; A75-B81; A75-B82; A75-B83; A75-B84; A75-B85; A75-B86; A75-B87; A75-B88; A75-B89; A75-B90; A75-B91; A75-B92; A75-B93; A75-B94; A75-B95; A75-B96; A75-B97; A75-B98; A75-B99; A75-B100; A75-B101; A75-B102; A75-B103; A75-B104; A75-B105; A75-B106; A75-B107; A75-B108; A75-B109; A75-B110; A75-B111; A75-B112; A75-B113;

A76-B1; A76-B2; A76-B3; A76-B4; A76-B5; A76-B6; A76-B7; A76-B8; A76-B9; A76-B10; A76-B11; A76-B12; A76-B13; A76-B14; A76-B15; A76-B16; A76-B17; A76-B18; A76-B19; A76-B20; A76-B21; A76-B22; A76-B23; A76-B24; A76-B25; A76-B26; A76-B27; A76-B28; A76-B29; A76-B30; A76-B31; A76-B32; A76-B33; A76-B34; A76-B35; A76-B36; A76-B37; A76-B38; A76-B39; A76-B40; A76-B41; A76-B42; A76-B43; A76-B44; A76-B45; A76-B46; A76-B47; A76-B48; A76-B49; A76-B50; A76-B51; A76-B52; A76-B53; A76-B54; A76-B55; A76-B56; A76-B57; A76-B58; A76-B59; A76-B60; A76-B61; A76-B62; A76-B63; A76-B64; A76-B65; A76-B66; A76-B67; A76-B68; A76-B69; A76-B70; A76-B71; A76-B72; A76-B73; A76-B74; A76-B75; A76-B76; A76-B77; A76-B78; A76-B79; A76-B80; A76-B81; A76-B82; A76-B83; A76-B84; A76-B85; A76-B86; A76-B87; A76-B88; A76-B89; A76-B90; A76-B91; A76-B92; A76-B93; A76-B94; A76-B95; A76-B96; A76-B97; A76-B98; A76-B99; A76-B100; A76-B101; A76-B102; A76-B103; A76-B104; A76-B105; A76-B106; A76-B107; A76-B108; A76-B109; A76-B110; A76-B111; A76-B112; A76-B113;

A77-B1; A77-B2; A77-B3; A77-B4; A77-B5; A77-B6; A77-B7; A77-B8; A77-B9; A77-B10; A77-B11; A77-B12; A77-B13; A77-B14; A77-B15; A77-B16; A77-B17; A77-B18; A77-B19; A77-B20; A77-B21; A77-B22; A77-B23; A77-B24; A77-B25; A77-B26; A77-B27; A77-B28; A77-B29; A77-B30; A77-B31; A77-B32; A77-B33; A77-B34; A77-B35; A77-B36; A77-B37; A77-B38; A77-B39; A77-B40; A77-B41; A77-B42; A77-B43; A77-B44; A77-B45; A77-B46; A77-B47; A77-B48; A77-B49; A77-B50; A77-B51; A77-B52; A77-B53; A77-B54; A77-B55; A77-B56; A77-B57; A77-B58; A77-B59; A77-B60; A77-B61; A77-B62; A77-B63; A77-B64; A77-B65; A77-B66; A77-B67; A77-B68; A77-B69; A77-B70; A77-B71; A77-B72; A77-B73; A77-B74; A77-B75; A77-B76; A77-B77; A77-B78; A77-B79; A77-B80; A77-B81; A77-B82; A77-B83; A77-B84; A77-B85; A77-B86; A77-B87; A77-B88; A77-B89; A77-B90; A77-B91; A77-B92; A77-B93; A77-B94; A77-B95; A77-B96; A77-B97; A77-B98; A77-B99; A77-B100; A77-B101; A77-B102; A77-B103; A77-B104; A77-B105; A77-B106; A77-B107; A77-B108; A77-B109; A77-B110; A77-B111; A77-B112; A77-B113;

Sub-Category IA: Amino Acid B of the Dipeptide Prodrug Element is N-Alkylated Glycine In some embodiments, the B amino acid of the dipeptide prodrug element is N-alkylated glycine. Nonlimiting examples of dipeptide prodrug elements having N-alkylated glycine as the B amino acid are shown in the below Table.

| Dipeptide Prodrug Element # | Amino Acid 'A' | Amino Acid 'B' |
|---|---|---|
| 1 | Aib | Gly(N—$C_1$-$C_8$alkyl) |
| 2 | d-Ala | Gly(N—$C_1$-$C_8$alkyl) |
| 3 | d-Lys | Gly(N—$C_1$-$C_8$alkyl) |
| 4 | d-Cys | Gly(N—$C_1$-$C_8$alkyl) |
| 5 | Aib | Gly(N-methyl) |
| 6 | d-Ala | Gly(N-methyl) |
| 7 | d-Lys | Gly(N-methyl) |
| 8 | d-Cys | Gly(N-methyl) |
| 9 | Aib | Gly(N-hexyl) |
| 10 | d-Ala | Gly(N-hexyl) |
| 11 | d-Lys | Gly(N-hexyl) |
| 12 | d-Cys | Gly(N-hexyl) |

Sub-Category IB: Amino Acid B of the Dipeptide Prodrug Element is Unsubstituted or Monosubstituted at the Beta Position In some embodiments, the B amino acid of the dipeptide prodrug element is unsubstituted or monosubstituted at the beta position and has a relatively non-bulky side chain. Nonlimiting examples of dipeptide prodrug elements having a B amino acid that is unsubstituted or monosubstituted at the beta position and a relatively non-bulky side chain are shown in the below Table.

| Dipeptide Prodrug Element # | Amino Acid 'A' | Amino Acid 'B' |
|---|---|---|
| 13 | Aib | Ala(N—$C_1$-$C_8$alkyl) |
| 14 | d-Ala | Ala(N—$C_1$-$C_8$alkyl) |
| 15 | d-Lys | Ala(N—$C_1$-$C_8$alkyl) |
| 16 | d-Cys | Ala(N—$C_1$-$C_8$alkyl) |
| 17 | Aib | Leu(N—$C_1$-$C_8$alkyl) |
| 18 | d-Ala | Leu(N—$C_1$-$C_8$alkyl) |
| 19 | d-Lys | Leu(N—$C_1$-$C_8$alkyl) |
| 20 | d-Cys | Leu(N—$C_1$-$C_8$alkyl) |
| 21 | Aib | Met(N—$C_1$-$C_8$alkyl) |
| 22 | d-Ala | Met(N—$C_1$-$C_8$alkyl) |
| 23 | d-Lys | Met(N—$C_1$-$C_8$alkyl) |
| 24 | d-Cys | Met(N—$C_1$-$C_8$alkyl) |
| 25 | Aib | Asn(N—$C_1$-$C_8$alkyl) |
| 26 | d-Ala | Asn(N—$C_1$-$C_8$alkyl) |
| 27 | d-Lys | Asn(N—$C_1$-$C_8$alkyl) |
| 28 | d-Cys | Asn(N—$C_1$-$C_8$alkyl) |
| 29 | Aib | Glu(N—$C_1$-$C_8$alkyl) |
| 30 | d-Ala | Glu(N—$C_1$-$C_8$alkyl) |
| 31 | d-Lys | Glu(N—$C_1$-$C_8$alkyl) |
| 32 | d-Cys | Glu(N—$C_1$-$C_8$alkyl) |
| 33 | Aib | Asp(N—$C_1$-$C_8$alkyl) |
| 34 | d-Ala | Asp(N—$C_1$-$C_8$alkyl) |
| 35 | d-Lys | Asp(N—$C_1$-$C_8$alkyl) |
| 36 | d-Cys | Asp(N—$C_1$-$C_8$alkyl) |
| 37 | Aib | Gln(N—$C_1$-$C_8$alkyl) |
| 38 | d-Ala | Gln(N—$C_1$-$C_8$alkyl) |
| 39 | d-Lys | Gln(N—$C_1$-$C_8$alkyl) |
| 40 | d-Cys | Gln(N—$C_1$-$C_8$alkyl) |
| 41 | Aib | His(N—$C_1$-$C_8$alkyl) |
| 42 | d-Ala | His(N—$C_1$-$C_8$alkyl) |
| 43 | d-Lys | His(N—$C_1$-$C_8$alkyl) |
| 44 | d-Cys | His(N—$C_1$-$C_8$alkyl) |
| 45 | Aib | Lys(N—$C_1$-$C_8$alkyl) |
| 46 | d-Ala | Lys(N—$C_1$-$C_8$alkyl) |
| 47 | d-Lys | Lys(N—$C_1$-$C_8$alkyl) |
| 48 | d-Cys | Lys(N—$C_1$-$C_8$alkyl) |
| 49 | Aib | Arg(N—$C_1$-$C_8$alkyl) |
| 50 | d-Ala | Arg(N—$C_1$-$C_8$alkyl) |
| 51 | d-Lys | Arg(N—$C_1$-$C_8$alkyl) |

| Dipeptide Prodrug Element # | Amino Acid 'A' | Amino Acid 'B' |
|---|---|---|
| 52 | d-Cys | Arg(N—C$_1$-C$_8$alkyl) |
| 53 | Aib | Ser(N—C$_1$-C$_8$alkyl) |
| 54 | d-Ala | Ser(N—C$_1$-C$_8$alkyl) |
| 55 | d-Lys | Ser(N—C$_1$-C$_8$alkyl) |
| 56 | d-Cys | Ser(N—C$_1$-C$_8$alkyl) |
| 57 | Aib | Cys(N—C$_1$-C$_8$alkyl) |
| 58 | d-Ala | Cys(N—C$_1$-C$_8$alkyl) |
| 59 | d-Lys | Cys(N—C$_1$-C$_8$alkyl) |
| 60 | d-Cys | Cys(N—C$_1$-C$_8$alkyl) |
| 61 | Aib | Pro |
| 62 | d-Ala | Pro |
| 63 | d-Lys | Pro |
| 64 | d-Cys | Pro |
| 65 | Aib | Ala(N-methyl) |
| 66 | d-Ala | Ala(N-methyl) |
| 67 | d-Lys | Ala(N-methyl) |
| 68 | d-Cys | Ala(N-methyl) |
| 69 | Aib | Leu(N-methyl) |
| 70 | d-Ala | Leu(N-methyl) |
| 71 | d-Lys | Leu(N-methyl) |
| 72 | d-Cys | Leu(N-methyl) |
| 73 | Aib | Met(N-methyl) |
| 74 | d-Ala | Met(N-methyl) |
| 75 | d-Lys | Met(N-methyl) |
| 76 | d-Cys | Met(N-methyl) |
| 77 | Aib | Asn(N-methyl) |
| 78 | d-Ala | Asn(N-methyl) |
| 79 | d-Lys | Asn(N-methyl) |
| 80 | d-Cys | Asn(N-methyl) |
| 81 | Aib | Glu(N-methyl) |
| 82 | d-Ala | Glu(N-methyl) |
| 83 | d-Lys | Glu(N-methyl) |
| 84 | d-Cys | Glu(N-methyl) |
| 85 | Aib | Asp(N-methyl) |
| 86 | d-Ala | Asp(N-methyl) |
| 87 | d-Lys | Asp(N-methyl) |
| 88 | d-Cys | Asp(N-methyl) |
| 89 | Aib | Gln(N-methyl) |
| 90 | d-Ala | Gln(N-methyl) |
| 91 | d-Lys | Gln(N-methyl) |
| 92 | d-Cys | Gln(N-methyl) |
| 93 | Aib | His(N-methyl) |
| 94 | d-Ala | His(N-methyl) |
| 95 | d-Lys | His(N-methyl) |
| 96 | d-Cys | His(N-methyl) |
| 97 | Aib | Lys(N-methyl) |
| 98 | d-Ala | Lys(N-methyl) |
| 99 | d-Lys | Lys(N-methyl) |
| 100 | d-Cys | Lys(N-methyl) |
| 101 | Aib | Arg(N-methyl) |
| 102 | d-Ala | Arg(N-methyl) |
| 103 | d-Lys | Arg(N-methyl) |
| 104 | d-Cys | Arg(N-methyl) |
| 105 | Aib | Ser(N-methyl) |
| 106 | d-Ala | Ser(N-methyl) |
| 107 | d-Lys | Ser(N-methyl) |
| 108 | d-Cys | Ser(N-methyl) |
| 109 | Aib | Cys(N-methyl) |
| 110 | d-Ala | Cys(N-methyl) |
| 111 | d-Lys | Cys(N-methyl) |
| 112 | d-Cys | Cys(N-methyl) |
| 113 | Aib | Ala(N-hexyl) |
| 114 | d-Ala | Ala(N-hexyl) |
| 115 | d-Lys | Ala(N-hexyl) |
| 116 | d-Cys | Ala(N-hexyl) |
| 117 | Aib | Leu(N-hexyl) |
| 118 | d-Ala | Leu(N-hexyl) |
| 119 | d-Lys | Leu(N-hexyl) |
| 120 | d-Cys | Leu(N-hexyl) |
| 121 | Aib | Met(N-hexyl) |
| 122 | d-Ala | Met(N-hexyl) |
| 123 | d-Lys | Met(N-hexyl) |
| 124 | d-Cys | Met(N-hexyl) |
| 125 | Aib | Asn(N-hexyl) |
| 126 | d-Ala | Asn(N-hexyl) |
| 127 | d-Lys | Asn(N-hexyl) |
| 128 | d-Cys | Asn(N-hexyl) |
| 129 | Aib | Glu(N-hexyl) |
| 130 | d-Ala | Glu(N-hexyl) |
| 131 | d-Lys | Glu(N-hexyl) |
| 132 | d-Cys | Glu(N-hexyl) |
| 133 | Aib | Asp(N-hexyl) |
| 134 | d-Ala | Asp(N-hexyl) |
| 135 | d-Lys | Asp(N-hexyl) |
| 136 | d-Cys | Asp(N-hexyl) |
| 137 | Aib | Gln(N-hexyl) |
| 138 | d-Ala | Gln(N-hexyl) |
| 139 | d-Lys | Gln(N-hexyl) |
| 140 | d-Cys | Gln(N-hexyl) |
| 141 | Aib | His(N-hexyl) |
| 142 | d-Ala | His(N-hexyl) |
| 143 | d-Lys | His(N-hexyl) |
| 144 | d-Cys | His(N-hexyl) |
| 145 | Aib | Lys(N-hexyl) |
| 146 | d-Ala | Lys(N-hexyl) |
| 147 | d-Lys | Lys(N-hexyl) |
| 148 | d-Cys | Lys(N-hexyl) |
| 149 | Aib | Arg(N-hexyl) |
| 150 | d-Ala | Arg(N-hexyl) |
| 151 | d-Lys | Arg(N-hexyl) |
| 152 | d-Cys | Arg(N-hexyl) |
| 153 | Aib | Ser(N-hexyl) |
| 154 | d-Ala | Ser(N-hexyl) |
| 155 | d-Lys | Ser(N-hexyl) |
| 156 | d-Cys | Ser(N-hexyl) |
| 157 | Aib | Cys(N-hexyl) |
| 158 | d-Ala | Cys(N-hexyl) |
| 159 | d-Lys | Cys(N-hexyl) |
| 160 | d-Cys | Cys(N-hexyl) |

In some embodiments, the B amino acid of the dipeptide prodrug element is monosubstituted at the beta position and has a relatively bulky side chain, as shown in the below Table.

| Dipeptide Prodrug Element # | Amino Acid 'A' | Amino Acid 'B' |
|---|---|---|
| 161 | Aib | Phe(N—C$_1$-C$_8$alkyl) |
| 162 | d-Ala | Phe(N—C$_1$-C$_8$alkyl) |
| 163 | d-Lys | Phe(N—C$_1$-C$_8$alkyl) |
| 164 | d-Cys | Phe(N—C$_1$-C$_8$alkyl) |
| 165 | Aib | Tyr(N—C$_1$-C$_8$alkyl) |
| 166 | d-Ala | Tyr(N—C$_1$-C$_8$alkyl) |
| 167 | d-Lys | Tyr(N—C$_1$-C$_8$alkyl) |
| 168 | d-Cys | Tyr(N—C$_1$-C$_8$alkyl) |
| 169 | Aib | Trp(N—C$_1$-C$_8$alkyl) |
| 170 | d-Ala | Trp(N—C$_1$-C$_8$alkyl) |
| 171 | d-Lys | Trp(N—C$_1$-C$_8$alkyl) |
| 172 | d-Cys | Trp(N—C$_1$-C$_8$alkyl) |
| 173 | Aib | Phe(N-methyl) |
| 174 | d-Ala | Phe(N-methyl) |
| 175 | d-Lys | Phe(N-methyl) |
| 176 | d-Cys | Phe(N-methyl) |
| 177 | Aib | Tyr(N-methyl) |
| 178 | d-Ala | Tyr(N-methyl) |
| 179 | d-Lys | Tyr(N-methyl) |
| 180 | d-Cys | Tyr(N-methyl) |
| 181 | Aib | Trp(N-methyl) |
| 182 | d-Ala | Trp(N-methyl) |
| 183 | d-Lys | Trp(N-methyl) |
| 184 | d-Cys | Trp(N-methyl) |
| 185 | Aib | Phe(N-hexyl) |
| 186 | d-Ala | Phe(N-hexyl) |
| 187 | d-Lys | Phe(N-hexyl) |
| 188 | d-Cys | Phe(N-hexyl) |
| 189 | Aib | Tyr(N-hexyl) |
| 190 | d-Ala | Tyr(N-hexyl) |
| 191 | d-Lys | Tyr(N-hexyl) |
| 192 | d-Cys | Tyr(N-hexyl) |
| 193 | Aib | Trp(N-hexyl) |
| 194 | d-Ala | Trp(N-hexyl) |

| Dipeptide Prodrug Element # | Amino Acid 'A' | Amino Acid 'B' |
|---|---|---|
| 195 | d-Lys | Trp(N-hexyl) |
| 196 | d-Cys | Trp(N-hexyl) |

Sub-Category IC: Amino Acid B of the Dipeptide Prodrug Element Disubstituted at the Beta Position In some embodiments, the B amino acid of the dipeptide prodrug element is disubstituted at the beta position. Nonlimiting examples of dipeptide prodrug elements having a B amino acid that is disubstituted at the beta position are shown in the below Table.

| Dipeptide Prodrug Element # | Amino Acid 'A' | Amino Acid 'B' |
|---|---|---|
| 197 | Aib | Ile(N—$C_1$-$C_8$alkyl) |
| 198 | d-Ala | Ile(N—$C_1$-$C_8$alkyl) |
| 199 | d-Lys | Ile(N—$C_1$-$C_8$alkyl) |
| 200 | d-Cys | Ile(N—$C_1$-$C_8$alkyl)) |
| 201 | Aib | Val(N—$C_1$-$C_8$alkyl) |
| 202 | d-Ala | Val(N—$C_1$-$C_8$alkyl) |
| 203 | d-Lys | Val(N—$C_1$-$C_8$alkyl) |
| 204 | d-Cys | Val(N—$C_1$-$C_8$alkyl) |
| 205 | Aib | Thr(N—$C_1$-$C_8$alkyl) |
| 206 | d-Ala | Thr(N—$C_1$-$C_8$alkyl) |
| 207 | d-Lys | Thr(N—$C_1$-$C_8$alkyl) |
| 208 | d-Cys | Thr(N—$C_1$-$C_8$alkyl) |
| 209 | Aib | Ile(N-methyl) |
| 210 | d-Ala | Ile(N-methyl) |
| 211 | d-Lys | Ile(N-methyl) |
| 212 | d-Cys | Ile(N-methyl)) |
| 213 | Aib | Val(N-methyl) |
| 214 | d-Ala | Val(N-methyl) |
| 215 | d-Lys | Val(N-methyl) |
| 216 | d-Cys | Val(N-methyl) |
| 217 | Aib | Thr(N-methyl) |
| 218 | d-Ala | Thr(N-methyl) |
| 219 | d-Lys | Thr(N-methyl) |
| 220 | d-Cys | Thr(N-methyl) |
| 221 | Aib | Ile(N-hexyl) |
| 222 | d-Ala | Ile(N-hexyl) |
| 223 | d-Lys | Ile(N-hexyl) |
| 224 | d-Cys | Ile(N-hexyl) |
| 225 | Aib | Val(N-hexyl) |
| 226 | d-Ala | Val(N-hexyl) |
| 227 | d-Lys | Val(N-hexyl) |
| 228 | d-Cys | Val(N-hexyl) |
| 229 | Aib | Thr(N-hexyl) |
| 230 | d-Ala | Thr(N-hexyl) |
| 231 | d-Lys | Thr(N-hexyl) |
| 232 | d-Cys | Thr(N-hexyl) |

Prodrugs

The dipeptide prodrug element is conjugated to any following glucagon related peptides through any position that interferes with the activity of the glucagon related peptide (e.g., to the alpha amine of the N-terminal amino acid, an aliphatic amino group on a side chain of an amino acid of Q (e.g., a lysine side chain), an aromatic amino group on a side chain of an amino acid of Q (e.g., aminophenylalanine, aminonapthylalanine, aminotryptophan, aminophenylglycine, aminohomophenylalanine). Exemplary positions when A-B is linked to an aliphatic amino group on a side chain of an amino acid of Q include positions 12, 16, 17, 18, 20, 28, or 29 of native glucagon (SEQ ID NO: 701). Exemplary positions when A-B is linked to an aromatic amino group on a side chain of an amino acid of Q include positions 10, 13, 22, or 25 of native glucagon (SEQ ID NO: 701). In some embodiments, the dipeptide prodrug element of the invention is conjugated to any one of SEQ ID NOs: 1-564, 566-570, 573-575, 577, 579-580, 585-612, 616, 618-632, 634-642, 647, 657-684, 701-732, 742-768, 801-878, 883-919, 1001-1262, 1301-1371, 1401-1518, 1701-1708, 1710, 1711, 1731-1734, 1738, 1740, 1741, 1745, and 1747-1776. For example, the dipeptide prodrug element can be conjugated to any one of SEQ ID NOs: 742-768.

In some exemplary embodiments, Aib-Gly(N-Hexyl), dLys-Gly(N-Hexyl), dCys-Gly(N-Hexyl), dAla-Gly(N-Hexyl), Aib-Gly(N-Methyl), dLys-Gly(N-Methyl), dCys-Gly(N-Methyl), dAla-Gly(N-Hexyl), Aib-Phe(N-Methyl), dLys-Phe(N-Methyl), dCys-Phe(N-Methyl), or dAla-Phe(N-Methyl) is conjugated to the N-terminal alpha amino group of any one of SEQ ID NOs: 742-745, 748-770, as represented by SEQ ID NOs.: 769-794 and listed in the below Table.

| Prodrug Number (P #) | Dipeptide Prodrug Element | Glucagon Related Peptide (SEQ ID NO.) |
|---|---|---|
| 1 | Aib-Gly(N-Hexyl) | 742 |
| 2 | Aib-Gly(N-Hexyl) | 743 |
| 3 | Aib-Gly(N-Hexyl) | 744 |
| 4 | Aib-Gly(N-Hexyl) | 745 |
| 5 | Aib-Gly(N-Hexyl) | 748 |
| 6 | Aib-Gly(N-Hexyl) | 749 |
| 7 | Aib-Gly(N-Hexyl) | 750 |
| 8 | Aib-Gly(N-Hexyl) | 751 |
| 9 | Aib-Gly(N-Hexyl) | 752 |
| 10 | Aib-Gly(N-Hexyl) | 753 |
| 11 | Aib-Gly(N-Hexyl) | 754 |
| 12 | Aib-Gly(N-Hexyl) | 755 |
| 13 | Aib-Gly(N-Hexyl) | 756 |
| 14 | Aib-Gly(N-Hexyl) | 757 |
| 15 | Aib-Gly(N-Hexyl) | 758 |
| 16 | Aib-Gly(N-Hexyl) | 759 |
| 17 | Aib-Gly(N-Hexyl) | 760 |
| 18 | Aib-Gly(N-Hexyl) | 761 |
| 19 | Aib-Gly(N-Hexyl) | 762 |
| 20 | Aib-Gly(N-Hexyl) | 763 |
| 21 | Aib-Gly(N-Hexyl) | 764 |
| 22 | Aib-Gly(N-Hexyl) | 765 |
| 23 | Aib-Gly(N-Hexyl) | 766 |
| 24 | Aib-Gly(N-Hexyl) | 767 |
| 25 | Aib-Gly(N-Hexyl) | 768 |
| 26 | dLys-Gly(N-Hexyl) | 742 |
| 27 | dLys-Gly(N-Hexyl) | 743 |
| 28 | dLys-Gly(N-Hexyl) | 744 |
| 29 | dLys-Gly(N-Hexyl) | 745 |
| 30 | dLys-Gly(N-Hexyl) | 748 |
| 31 | dLys-Gly(N-Hexyl) | 749 |
| 32 | dLys-Gly(N-Hexyl) | 750 |
| 33 | dLys-Gly(N-Hexyl) | 751 |
| 34 | dLys-Gly(N-Hexyl) | 752 |
| 35 | dLys-Gly(N-Hexyl) | 753 |
| 36 | dLys-Gly(N-Hexyl) | 754 |
| 37 | dLys-Gly(N-Hexyl) | 755 |
| 38 | dLys-Gly(N-Hexyl) | 756 |
| 39 | dLys-Gly(N-Hexyl) | 757 |
| 40 | dLys-Gly(N-Hexyl) | 758 |
| 41 | dLys-Gly(N-Hexyl) | 759 |
| 42 | dLys-Gly(N-Hexyl) | 760 |
| 43 | dLys-Gly(N-Hexyl) | 761 |
| 44 | dLys-Gly(N-Hexyl) | 762 |
| 45 | dLys-Gly(N-Hexyl) | 763 |
| 46 | dLys-Gly(N-Hexyl) | 764 |
| 47 | dLys-Gly(N-Hexyl) | 765 |
| 48 | dLys-Gly(N-Hexyl) | 766 |
| 49 | dLys-Gly(N-Hexyl) | 767 |
| 50 | dLys-Gly(N-Hexyl) | 768 |
| 51 | dCys-Gly(N-Hexyl) | 742 |
| 52 | dCys-Gly(N-Hexyl) | 743 |
| 53 | dCys-Gly(N-Hexyl) | 744 |
| 54 | dCys-Gly(N-Hexyl) | 745 |
| 55 | dCys-Gly(N-Hexyl) | 748 |
| 56 | dCys-Gly(N-Hexyl) | 749 |
| 57 | dCys-Gly(N-Hexyl) | 750 |
| 58 | dCys-Gly(N-Hexyl) | 751 |
| 59 | dCys-Gly(N-Hexyl) | 752 |
| 60 | dCys-Gly(N-Hexyl) | 753 |

| Prodrug Number (P #) | Dipeptide Prodrug Element | Glucagon Related Peptide (SEQ ID NO.) |
|---|---|---|
| 61 | dCys-Gly(N-Hexyl) | 754 |
| 62 | dCys-Gly(N-Hexyl) | 755 |
| 63 | dCys-Gly(N-Hexyl) | 756 |
| 64 | dCys-Gly(N-Hexyl) | 757 |
| 65 | dCys-Gly(N-Hexyl) | 758 |
| 66 | dCys-Gly(N-Hexyl) | 759 |
| 67 | dCys-Gly(N-Hexyl) | 760 |
| 68 | dCys-Gly(N-Hexyl) | 761 |
| 69 | dCys-Gly(N-Hexyl) | 762 |
| 70 | dCys-Gly(N-Hexyl) | 763 |
| 71 | dCys-Gly(N-Hexyl) | 764 |
| 72 | dCys-Gly(N-Hexyl) | 765 |
| 73 | dCys-Gly(N-Hexyl) | 766 |
| 74 | dCys-Gly(N-Hexyl) | 767 |
| 75 | dCys-Gly(N-Hexyl) | 768 |
| 76 | dAla-Gly(N-Hexyl) | 742 |
| 77 | dAla-Gly(N-Hexyl) | 743 |
| 78 | dAla-Gly(N-Hexyl) | 744 |
| 79 | dAla-Gly(N-Hexyl) | 745 |
| 80 | dAla-Gly(N-Hexyl) | 748 |
| 81 | dAla-Gly(N-Hexyl) | 749 |
| 82 | dAla-Gly(N-Hexyl) | 750 |
| 83 | dAla-Gly(N-Hexyl) | 751 |
| 84 | dAla-Gly(N-Hexyl) | 752 |
| 85 | dAla-Gly(N-Hexyl) | 753 |
| 86 | dAla-Gly(N-Hexyl) | 754 |
| 87 | dAla-Gly(N-Hexyl) | 755 |
| 88 | dAla-Gly(N-Hexyl) | 756 |
| 89 | dAla-Gly(N-Hexyl) | 757 |
| 90 | dAla-Gly(N-Hexyl) | 758 |
| 91 | dAla-Gly(N-Hexyl) | 759 |
| 92 | dAla-Gly(N-Hexyl) | 760 |
| 93 | dAla-Gly(N-Hexyl) | 761 |
| 94 | dAla-Gly(N-Hexyl) | 762 |
| 95 | dAla-Gly(N-Hexyl) | 763 |
| 96 | dAla-Gly(N-Hexyl) | 764 |
| 97 | dAla-Gly(N-Hexyl) | 765 |
| 98 | dAla-Gly(N-Hexyl) | 766 |
| 99 | dAla-Gly(N-Hexyl) | 767 |
| 100 | dAla-Gly(N-Hexyl) | 768 |
| 101 | Aib-Gly(N-Methyl) | 742 |
| 102 | Aib-Gly(N-Methyl) | 743 |
| 103 | Aib-Gly(N-Methyl) | 744 |
| 104 | Aib-Gly(N-Methyl) | 745 |
| 105 | Aib-Gly(N-Methyl) | 748 |
| 106 | Aib-Gly(N-Methyl) | 749 |
| 107 | Aib-Gly(N-Methyl) | 750 |
| 108 | Aib-Gly(N-Methyl) | 751 |
| 109 | Aib-Gly(N-Methyl) | 752 |
| 110 | Aib-Gly(N-Methyl) | 753 |
| 111 | Aib-Gly(N-Methyl) | 754 |
| 112 | Aib-Gly(N-Methyl) | 755 |
| 113 | Aib-Gly(N-Methyl) | 756 |
| 114 | Aib-Gly(N-Methyl) | 757 |
| 115 | Aib-Gly(N-Methyl) | 758 |
| 116 | Aib-Gly(N-Methyl) | 759 |
| 117 | Aib-Gly(N-Methyl) | 760 |
| 118 | Aib-Gly(N-Methyl) | 761 |
| 119 | Aib-Gly(N-Methyl) | 762 |
| 120 | Aib-Gly(N-Methyl) | 763 |
| 121 | Aib-Gly(N-Methyl) | 764 |
| 122 | Aib-Gly(N-Methyl) | 765 |
| 123 | Aib-Gly(N-Methyl) | 766 |
| 124 | Aib-Gly(N-Methyl) | 767 |
| 125 | Aib-Gly(N-Methyl) | 768 |
| 126 | dLys-Gly(N-Methyl) | 742 |
| 127 | dLys-Gly(N-Methyl) | 743 |
| 128 | dLys-Gly(N-Methyl) | 744 |
| 129 | dLys-Gly(N-Methyl) | 745 |
| 130 | dLys-Gly(N-Methyl) | 748 |
| 131 | dLys-Gly(N-Methyl) | 749 |
| 132 | dLys-Gly(N-Methyl) | 750 |
| 133 | dLys-Gly(N-Methyl) | 751 |
| 134 | dLys-Gly(N-Methyl) | 752 |
| 135 | dLys-Gly(N-Methyl) | 753 |
| 136 | dLys-Gly(N-Methyl) | 754 |
| 137 | dLys-Gly(N-Methyl) | 755 |
| 138 | dLys-Gly(N-Methyl) | 756 |
| 139 | dLys-Gly(N-Methyl) | 757 |
| 140 | dLys-Gly(N-Methyl) | 758 |
| 141 | dLys-Gly(N-Methyl) | 759 |
| 142 | dLys-Gly(N-Methyl) | 760 |
| 143 | dLys-Gly(N-Methyl) | 761 |
| 144 | dLys-Gly(N-Methyl) | 762 |
| 145 | dLys-Gly(N-Methyl) | 763 |
| 146 | dLys-Gly(N-Methyl) | 764 |
| 147 | dLys-Gly(N-Methyl) | 765 |
| 148 | dLys-Gly(N-Methyl) | 766 |
| 149 | dLys-Gly(N-Methyl) | 767 |
| 150 | dLys-Gly(N-Methyl) | 768 |
| 151 | dCys-Gly(N-Methyl) | 742 |
| 152 | dCys-Gly(N-Methyl) | 743 |
| 153 | dCys-Gly(N-Methyl) | 744 |
| 154 | dCys-Gly(N-Methyl) | 745 |
| 155 | dCys-Gly(N-Methyl) | 748 |
| 156 | dCys-Gly(N-Methyl) | 749 |
| 157 | dCys-Gly(N-Methyl) | 750 |
| 158 | dCys-Gly(N-Methyl) | 751 |
| 159 | dCys-Gly(N-Methyl) | 752 |
| 160 | dCys-Gly(N-Methyl) | 753 |
| 161 | dCys-Gly(N-Methyl) | 754 |
| 162 | dCys-Gly(N-Methyl) | 755 |
| 163 | dCys-Gly(N-Methyl) | 756 |
| 164 | dCys-Gly(N-Methyl) | 757 |
| 165 | dCys-Gly(N-Methyl) | 758 |
| 166 | dCys-Gly(N-Methyl) | 759 |
| 167 | dCys-Gly(N-Methyl) | 760 |
| 168 | dCys-Gly(N-Methyl) | 761 |
| 169 | dCys-Gly(N-Methyl) | 762 |
| 170 | dCys-Gly(N-Methyl) | 763 |
| 171 | dCys-Gly(N-Methyl) | 764 |
| 172 | dCys-Gly(N-Methyl) | 765 |
| 173 | dCys-Gly(N-Methyl) | 766 |
| 174 | dCys-Gly(N-Methyl) | 767 |
| 175 | dCys-Gly(N-Methyl) | 768 |
| 176 | dAla-Gly(N-Methyl) | 742 |
| 177 | dAla-Gly(N-Methyl) | 743 |
| 178 | dAla-Gly(N-Methyl) | 744 |
| 179 | dAla-Gly(N-Methyl) | 745 |
| 180 | dAla-Gly(N-Methyl) | 748 |
| 181 | dAla-Gly(N-Methyl) | 749 |
| 182 | dAla-Gly(N-Methyl) | 750 |
| 183 | dAla-Gly(N-Methyl) | 751 |
| 184 | dAla-Gly(N-Methyl) | 752 |
| 185 | dAla-Gly(N-Methyl) | 753 |
| 186 | dAla-Gly(N-Methyl) | 754 |
| 187 | dAla-Gly(N-Methyl) | 755 |
| 188 | dAla-Gly(N-Methyl) | 756 |
| 189 | dAla-Gly(N-Methyl) | 757 |
| 190 | dAla-Gly(N-Methyl) | 758 |
| 191 | dAla-Gly(N-Methyl) | 759 |
| 192 | dAla-Gly(N-Methyl) | 760 |
| 193 | dAla-Gly(N-Methyl) | 761 |
| 194 | dAla-Gly(N-Methyl) | 762 |
| 195 | dAla-Gly(N-Methyl) | 763 |
| 196 | dAla-Gly(N-Methyl) | 764 |
| 197 | dAla-Gly(N-Methyl) | 765 |
| 198 | dAla-Gly(N-Methyl) | 766 |
| 199 | dAla-Gly(N-Methyl) | 767 |
| 200 | dAla-Gly(N-Methyl) | 768 |
| 201 | Aib-Phe(N-Methyl) | 742 |
| 202 | Aib-Phe(N-Methyl) | 743 |
| 203 | Aib-Phe(N-Methyl) | 744 |
| 204 | Aib-Phe(N-Methyl) | 745 |
| 205 | Aib-Phe(N-Methyl) | 748 |
| 206 | Aib-Phe(N-Methyl) | 749 |
| 207 | Aib-Phe(N-Methyl) | 750 |
| 208 | Aib-Phe(N-Methyl) | 751 |
| 209 | Aib-Phe(N-Methyl) | 752 |
| 210 | Aib-Phe(N-Methyl) | 753 |
| 211 | Aib-Phe(N-Methyl) | 754 |
| 212 | Aib-Phe(N-Methyl) | 755 |

| Prodrug Number (P #) | Dipeptide Prodrug Element | Glucagon Related Peptide (SEQ ID NO.) |
|---|---|---|
| 213 | Aib-Phe(N-Methyl) | 756 |
| 214 | Aib-Phe(N-Methyl) | 757 |
| 215 | Aib-Phe(N-Methyl) | 758 |
| 216 | Aib-Phe(N-Methyl) | 759 |
| 217 | Aib-Phe(N-Methyl) | 760 |
| 218 | Aib-Phe(N-Methyl) | 761 |
| 219 | Aib-Phe(N-Methyl) | 762 |
| 220 | Aib-Phe(N-Methyl) | 763 |
| 221 | Aib-Phe(N-Methyl) | 764 |
| 222 | Aib-Phe(N-Methyl) | 765 |
| 223 | Aib-Phe(N-Methyl) | 766 |
| 224 | Aib-Phe(N-Methyl) | 767 |
| 225 | Aib-Phe(N-Methyl) | 768 |
| 226 | dLys-Phe(N-Methyl) | 742 |
| 227 | dLys-Phe(N-Methyl) | 743 |
| 228 | dLys-Phe(N-Methyl) | 744 |
| 229 | dLys-Phe(N-Methyl) | 745 |
| 230 | dLys-Phe(N-Methyl) | 748 |
| 231 | dLys-Phe(N-Methyl) | 749 |
| 232 | dLys-Phe(N-Methyl) | 750 |
| 233 | dLys-Phe(N-Methyl) | 751 |
| 234 | dLys-Phe(N-Methyl) | 752 |
| 235 | dLys-Phe(N-Methyl) | 753 |
| 236 | dLys-Phe(N-Methyl) | 754 |
| 237 | dLys-Phe(N-Methyl) | 755 |
| 238 | dLys-Phe(N-Methyl) | 756 |
| 239 | dLys-Phe(N-Methyl) | 757 |
| 240 | dLys-Phe(N-Methyl) | 758 |
| 241 | dLys-Phe(N-Methyl) | 759 |
| 242 | dLys-Phe(N-Methyl) | 760 |
| 243 | dLys-Phe(N-Methyl) | 761 |
| 244 | dLys-Phe(N-Methyl) | 762 |
| 245 | dLys-Phe(N-Methyl) | 763 |
| 246 | dLys-Phe(N-Methyl) | 764 |
| 247 | dLys-Phe(N-Methyl) | 765 |
| 248 | dLys-Phe(N-Methyl) | 766 |
| 249 | dLys-Phe(N-Methyl) | 767 |
| 250 | dLys-Phe(N-Methyl) | 768 |
| 251 | dCys-Phe(N-Methyl) | 742 |
| 252 | dCys-Phe(N-Methyl) | 743 |
| 253 | dCys-Phe(N-Methyl) | 744 |
| 254 | dCys-Phe(N-Methyl) | 745 |
| 255 | dCys-Phe(N-Methyl) | 748 |
| 256 | dCys-Phe(N-Methyl) | 749 |
| 257 | dCys-Phe(N-Methyl) | 750 |
| 258 | dCys-Phe(N-Methyl) | 751 |
| 259 | dCys-Phe(N-Methyl) | 752 |
| 260 | dCys-Phe(N-Methyl) | 753 |
| 261 | dCys-Phe(N-Methyl) | 754 |
| 262 | dCys-Phe(N-Methyl) | 755 |
| 263 | dCys-Phe(N-Methyl) | 756 |
| 264 | dCys-Phe(N-Methyl) | 757 |
| 265 | dCys-Phe(N-Methyl) | 758 |
| 266 | dCys-Phe(N-Methyl) | 759 |
| 267 | dCys-Phe(N-Methyl) | 760 |
| 268 | dCys-Phe(N-Methyl) | 761 |
| 269 | dCys-Phe(N-Methyl) | 762 |
| 267 | dCys-Phe(N-Methyl) | 763 |
| 271 | dCys-Phe(N-Methyl) | 764 |
| 272 | dCys-Phe(N-Methyl) | 765 |
| 273 | dCys-Phe(N-Methyl) | 766 |
| 274 | dCys-Phe(N-Methyl) | 767 |
| 275 | dCys-Phe(N-Methyl) | 768 |
| 276 | dAla-Phe(N-Methyl) | 742 |
| 277 | dAla-Phe(N-Methyl) | 743 |
| 278 | dAla-Phe(N-Methyl) | 744 |
| 279 | dAla-Phe(N-Methyl) | 745 |
| 280 | dAla-Phe(N-Methyl) | 748 |
| 281 | dAla-Phe(N-Methyl) | 749 |
| 282 | dAla-Phe(N-Methyl) | 750 |
| 283 | dAla-Phe(N-Methyl) | 751 |
| 284 | dAla-Phe(N-Methyl) | 752 |
| 285 | dAla-Phe(N-Methyl) | 753 |
| 286 | dAla-Phe(N-Methyl) | 754 |
| 287 | dAla-Phe(N-Methyl) | 755 |
| 288 | dAla-Phe(N-Methyl) | 756 |
| 289 | dAla-Phe(N-Methyl) | 757 |
| 290 | dAla-Phe(N-Methyl) | 758 |
| 291 | dAla-Phe(N-Methyl) | 759 |
| 292 | dAla-Phe(N-Methyl) | 760 |
| 293 | dAla-Phe(N-Methyl) | 761 |
| 294 | dAla-Phe(N-Methyl) | 762 |
| 295 | dAla-Phe(N-Methyl) | 763 |
| 296 | dAla-Phe(N-Methyl) | 764 |
| 297 | dAla-Phe(N-Methyl) | 765 |
| 298 | dAla-Phe(N-Methyl) | 766 |
| 299 | dAla-Phe(N-Methyl) | 767 |
| 300 | dAla-Phe(N-Methyl) | 768 |

Methods of Use

Glucagon Superfamily Peptides

In general, prodrugs comprising a glucagon superfamily peptide or a glucagon related peptide, such as a Class 1, 2, 3, 4 or 5 peptide may be used for any purpose for which glucagon superfamily peptides and glucagon related peptides have been used (see for example as detailed above). For example, the disclosed bioactive peptide prodrug analogs are believed to be suitable for any use that has previously been described for its corresponding parent bioactive peptide. Accordingly, the glucagon related peptide prodrug analogs described herein can be used to treat hypoglycemia, hyperglycemia, diabetes, or other metabolic diseases that result from high/low blood levels of glucagon or high/low blood glucose levels. In accordance with some embodiments the patient to be treated using the prodrug disclosed herein is a domesticated animal, and in another embodiment the patient to be treated is a human.

In some embodiments, the prodrugs are used to reduce or suppress appetite, reduce food intake, induce weight loss, or assist in weight maintenance. Such methods for reducing appetite or promoting loss of body weight are expected to be useful in reducing body weight, preventing weight gain, or treating obesity of various causes, including drug-induced obesity, and reducing complications associated with obesity including vascular disease (coronary artery disease, stroke, peripheral vascular disease, ischemia reperfusion, etc.), hypertension, onset of diabetes type II, hyperlipidemia and musculoskeletal diseases.

In other embodiments, the prodrugs are used in conjunction with parenteral administration of nutrients to non-diabetic patients in a hospital setting, e.g., to patients receiving parenteral nutrition or total parenteral nutrition. Nonlimintting examples include surgery patients, patients in comas, patients with digestive tract illness, or a nonfunctional gastrointestinal tract (e.g. due to surgical removal, blockage or impaired absorptive capacity, Crohn's disease, ulcerative colitis, gastrointestinal tract obstruction, gastrointestinal tract fistula, acute pancreatitis, ischemic bowel, major gastrointestinal surgery, certain congenital gastrointestinal tract anomalies, prolonged diarrhea, or short bowel syndrome due to surgery, patients in shock, and patients undergoing healing processes often receive parenteral administration of carbohydrates along with various combinations of lipids, electrolytes, minerals, vitamins and amino acids. The glucagon superfamily peptide prodrug and the parenteral nutrition composition can be administered at the same time, at different times, before, or after each other, provided that the glucagon superfamily peptide prodrug is exerting the desired biological effect at the time that the parenteral nutrition composition is being digested. For example, the parenteral nutrition may be administered, 1, 2 or 3 times per day, while the glucagon superfamily peptide prodrug is administered once every other day, three times a week, two times a week, once a week, once every 2 weeks, once every 3 weeks, or once a month.

Metabolic Syndrome, also known as metabolic syndrome X, insulin resistance syndrome or Reaven's syndrome, is a disorder that affects over 50 million Americans. Metabolic Syndrome is typically characterized by a clustering of at least three or more of the following risk factors: (1) abdominal obesity (excessive fat tissue in and around the abdomen), (2) atherogenic dyslipidemia (blood fat disorders including high triglycerides, low HDL cholesterol and high LDL cholesterol that enhance the accumulation of plaque in the artery walls), (3) elevated blood pressure, (4) insulin resistance or glucose intolerance, (5) prothrombotic state (e.g. high fibrinogen or plasminogen activator inhibitor-1 in blood), and (6) pro-inflammatory state (e.g. elevated C-reactive protein in blood). Other risk factors may include aging, hormonal imbalance and genetic predisposition.

Metabolic Syndrome is associated with an increased the risk of coronary heart disease and other disorders related to the accumulation of vascular plaque, such as stroke and peripheral vascular disease, referred to as atherosclerotic cardiovascular disease (ASCVD). Patients with Metabolic Syndrome may progress from an insulin resistant state in its early stages to full blown type II diabetes with further increasing risk of ASCVD. Without intending to be bound by any particular theory, the relationship between insulin resistance, Metabolic Syndrome and vascular disease may involve one or more concurrent pathogenic mechanisms including impaired insulin-stimulated vasodilation, insulin resistance-associated reduction in NO availability due to enhanced oxidative stress, and abnormalities in adipocyte-derived hormones such as adiponectin (Lteif and Mather, Can. J. Cardiol. 20 (suppl. B):66B-76B (2004)).

According to the 2001 National Cholesterol Education Program Adult Treatment Panel (ATP III), any three of the following traits in the same individual meet the criteria for Metabolic Syndrome: (a) abdominal obesity (a waist circumference over 102 cm in men and over 88 cm in women); (b) serum triglycerides (150 mg/dl or above); (c) HDL cholesterol (40 mg/dl or lower in men and 50 mg/dl or lower in women); (d) blood pressure (130/85 or more); and (e) fasting blood glucose (110 mg/dl or above). According to the World Health Organization (WHO), an individual having high insulin levels (an elevated fasting blood glucose or an elevated post meal glucose alone) with at least two of the following criteria meets the criteria for Metabolic Syndrome: (a) abdominal obesity (waist to hip ratio of greater than 0.9, a body mass index of at least 30 kg/m$^2$, or a waist measurement over 37 inches); (b) cholesterol panel showing a triglyceride level of at least 150 mg/dl or an HDL cholesterol lower than 35 mg/dl; (c) blood pressure of 140/90 or more, or on treatment for high blood pressure). (Mathur, Ruchi, "Metabolic Syndrome," ed. Shiel, Jr., William C., MedicineNet.com, May 11, 2009).

For purposes herein, if an individual meets the criteria of either or both of the criteria set forth by the 2001 National Cholesterol Education Program Adult Treatment Panel or the WHO, that individual is considered as afflicted with Metabolic Syndrome.

Without being bound to any particular theory, glucagon peptides described herein are useful for treating Metabolic Syndrome. Accordingly, the invention provides a method of preventing or treating Metabolic Syndrome, or reducing one, two, three or more risk factors thereof, in a subject, comprising administering to the subject a glucagon peptide described herein in an amount effective to prevent or treat Metabolic Syndrome, or the risk factor thereof.

Nonalcoholic fatty liver disease (NAFLD) refers to a wide spectrum of liver disease ranging from simple fatty liver (steatosis), to nonalcoholic steatohepatitis (NASH), to cirrhosis (irreversible, advanced scarring of the liver). All of the stages of NAFLD have in common the accumulation of fat (fatty infiltration) in the liver cells (hepatocytes). Simple fatty liver is the abnormal accumulation of a certain type of fat, triglyceride, in the liver cells with no inflammation or scarring. In NASH, the fat accumulation is associated with varying degrees of inflammation (hepatitis) and scarring (fibrosis) of the liver. The inflammatory cells can destroy the liver cells (hepatocellular necrosis). In the terms "steatohepatitis" and "steatonecrosis", steato refers to fatty infiltration, hepatitis refers to inflammation in the liver, and necrosis refers to destroyed liver cells. NASH can ultimately lead to scarring of the liver (fibrosis) and then irreversible, advanced scarring (cirrhosis). Cirrhosis that is caused by NASH is the last and most severe stage in the NAFLD spectrum. (Mendler, Michel, "Fatty Liver: Nonalcoholic Fatty Liver Disease (NAFLD) and Nonalcoholic Steatohepatitis (NASH)," ed. Schoenfield, Leslie J., MedicineNet.com, Aug. 29, 2005).

Alcoholic Liver Disease, or Alcohol-Induced Liver Disease, encompasses three pathologically distinct liver diseases related to or caused by the excessive consumption of alcohol: fatty liver (steatosis), chronic or acute hepatitis, and cirrhosis. Alcoholic hepatitis can range from a mild hepatitis, with abnormal laboratory tests being the only indication of disease, to severe liver dysfunction with complications such as jaundice (yellow skin caused by bilirubin retention), hepatic encephalopathy (neurological dysfunction caused by liver failure), ascites (fluid accumulation in the abdomen), bleeding esophageal varices (varicose veins in the esophagus), abnormal blood clotting and coma. Histologically, alcoholic hepatitis has a characteristic appearance with ballooning degeneration of hepatocytes, inflammation with neutrophils and sometimes Mallory bodies (abnormal aggregations of cellular intermediate filament proteins). Cirrhosis is characterized anatomically by widespread nodules in the liver combined with fibrosis. (Worman, Howard J., "Alcoholic Liver Disease", Columbia University Medical Center website).

Without being bound to any particular theory, Class 2 and Class 3 glucagon related peptides described herein are useful for the treatment of Alcoholic Liver Disease, NAFLD, or any stage thereof, including, for example, steatosis, steatohepatitis, hepatitis, hepatic inflammation, NASH, cirrhosis, or complications thereof. Accordingly, the invention provides a method of preventing or treating Alcoholic Liver Disease, NAFLD, or any stage thereof, in a subject comprising administering to a subject a Class 2 or Class 3 glucagon peptide described herein in an amount effective to prevent or treat Alcoholic Liver Disease, NAFLD, or the stage thereof. Such treatment methods include reduction in one, two, three or more of the following: liver fat content, incidence or progression of cirrhosis, incidence of hepatocellular carcinoma, signs of inflammation, e.g. abnormal hepatic enzyme levels (e.g., aspartate aminotransferase AST and/or alanine aminotransferase ALT, or LDH), elevated serum ferritin, elevated serum bilirubin, and/or signs of fibrosis, e.g. elevated TGF-beta levels. In preferred embodiments, the Class 2 or Class 3 glucagon peptides are used treat patients who have progressed beyond simple fatty liver (steatosis) and exhibit signs of inflammation or hepatitis. Such methods may result, for example, in reduction of AST and/or ALT levels.

GLP-1 and exendin-4 have been shown to have some neuroprotective effect. The invention also provides uses of the glucagon superfamily peptides in treating neurodegenerative diseases, including but not limited to Alzheimer's disease, Parkinson's disease, Multiple Sclerosis, Amylotrophic Lateral Sclerosis, other demyelination related disorders, senile dementia, subcortical dementia, arteriosclerotic dementia, AIDS-associated dementia, or other dementias, a central nervous system cancer, traumatic brain injury, spinal cord injury, stroke or cerebral ischemia, cerebral vasculitis, epilepsy, Huntington's disease, Tourette's syndrome, Guillain Barre syndrome, Wilson disease, Pick's disease, neuroinflammatory disorders, encephalitis, encephalomyelitis or meningitis of viral, fungal or bacterial origin, or other central nervous system infections, prion diseases, cerebellar ataxias, cerebellar degeneration, spinocerebellar degeneration syndromes, Friedreichs ataxia, ataxia telangiectasia, spinal dysmyotrophy, progressive supranuclear palsy, dystonia, muscle spasticity, tremor, retinitis pigmentosa, striatonigral degeneration, mitochondrial encephalo-myopathies, neuronal ceroid lipofuscinosis, hepatic encephalopathies, renal encephalopathies, metabolic encephalopathies, toxin-induced encephalopathies, and radiation-induced brain damage.

Accordingly, the invention provides a method of preventing or treating neurodegenerative diseases, or reducing one, two, three or more risk factors thereof, in a subject, comprising administering to the subject a glucagon peptide described herein in an amount effective to prevent or treat a neurodegenerative disease, or the risk factor thereof.

The method of treating in accordance with the present invention comprises the steps of administering the presently disclosed prodrugs to a patient using any standard route of administration, including parenterally, such as intravenously, intraperitoneally, subcutaneously or intramuscularly, intrathecally, transdermally, rectally, orally, nasally or by inhalation. In some embodiments the composition is administered subcutaneously or intramuscularly, optionally into a depot or as part of a slow-release composition.

Compositions and Combinations

The prodrugs of the invention may be administered alone or in combination with a second agent such as anti-diabetic or anti-obesity agents. In some aspects, a prodrug is administered in combination with a second prodrug or a glucagon superfamily member, including for example a glucagon related peptide. In certain embodiments, a prodrug is administered in combination with and anti-diabetic agent, including but not limited to insulin, sulfonylureas, such as tolbutamide (Orinase), acetohexamide (Dymelor), tolazamide (Tolinase), chlorpropamide (Diabinese), glipizide (Glucotrol), glyburide (Diabeta, Micronase, Glynase), glimepiride (Amaryl), or gliclazide (Diamicron); meglitinides, such as repaglinide (Prandin) or nateglinide (Starlix); biguanides such as metformin (Glucophage) or phenformin; thiazolidinediones such as rosiglitazone (Avandia), pioglitazone (Actos), or troglitazone (Rezulin), or other PPARγ inhibitors; alpha glucosidase inhibitors that inhibit carbohydrate digestion, such as miglitol (Glyset), acarbose (Precose/Glucobay); exenatide (Byetta) or pramlintide; Dipeptidyl peptidase-4 (DPP-IV) inhibitors such as vildagliptin or sitagliptin; SGLT (sodium-dependent glucose transporter 1) inhibitors; or FBPase (fructose 1,6-bisphosphatase) inhibitors.

Anti-obesity agents known in the art or under investigation include but are not limited to appetite suppressants, including phenethylamine type stimulants, phentermine (optionally with fenfluramine or dexfenfluramine), diethylpropion (Tenuate®), phendimetrazine (Prelu-2®, Bontril®), benzphetamine (Didrex®), sibutramine (Meridia®, Reductil®); rimonabant (Acomplia®), other cannabinoid receptor antagonists; oxyntomodulin; fluoxetine hydrochloride (Prozac); Qnexa (topiramate and phentermine), Excalia (bupropion and zonisamide) or Contrave (bupropion and naltrexone); or lipase inhibitors, similar to xenical (Orlistat) or Cetilistat (also known as ATL-962), or GT 389-255.

The prodrugs of the present invention can also be administered to patients suffering from catabolic wasting. It is estimated that over half of cancer patients experience catabolic wasting which is characterized by unintended and progressive weight loss, weakness, and low body fat and muscle. The syndrome is equally common in AIDS patients and can also be present in bacterial and parasitic diseases, rheumatoid arthritis, and chronic diseases of the bowel, liver, lungs, and heart. It is usually associated with anorexia and can manifest as a condition in aging or as a result of physical trauma. Catabolic wasting is a symptom that diminishes the quality of life, worsens the underlying condition, and is a major cause of death.

Pharmaceutical compositions comprising the prodrugs disclosed herein can be formulated and administered to patients using standard pharmaceutically acceptable carriers and routes of administration known to those skilled in the art. Accordingly, the present disclosure also encompasses pharmaceutical compositions comprising one or more of the prodrugs disclosed herein, or a pharmaceutically acceptable salt thereof, in combination with a pharmaceutically acceptable carrier. In some embodiments the pharmaceutical composition comprises a 1 mg/ml concentration of the prodrug at pH of about 4.0 to about 7.0 in a phosphate buffer system. The pharmaceutical compositions may comprise the prodrug as the sole pharmaceutically active component, or the prodrugs can be combined with one or more additional active agents. In accordance with some embodiments a composition is provided comprising a prodrug of the present invention. Alternatively, a composition is provided for inducing weight loss or preventing weight gain can be provided that comprises a prodrug and an anti-obesity peptide. Suitable anti-obesity peptides include those disclosed in U.S. Pat. Nos. 5,691,309, 6,436,435 or US Patent application 20050176643.

In accordance with some embodiments a pharmaceutical composition is provided comprising any of the novel prodrugs disclosed herein, preferably sterile and preferably at a purity level of at least 90%, 91%, 92%, 93%, 94%, 95%, 96%, 97%, 98% or 99%, and a pharmaceutically acceptable diluent, carrier or excipient. Such compositions may contain a bioactive peptide prodrug derivative as disclosed herein, wherein the resulting active peptide is present at a concentration of at least 0.5 mg/ml, 1 mg/ml, 2 mg/ml, 3 mg/ml, 4 mg/ml, 5 mg/ml, 6 mg/ml, 7 mg/ml, 8 mg/ml, 9 mg/ml, 10 mg/ml, 11 mg/ml, 12 mg/ml, 13 mg/ml, 14 mg/ml, 15 mg/ml, 16 mg/ml, 17 mg/ml, 18 mg/ml, 19 mg/ml, 20 mg/ml, 21 mg/ml, 22 mg/ml, 23 mg/ml, 24 mg/ml, 25 mg/ml or higher. Such compositions may contain a bioactive peptide prodrug derivative of Class 1, 2, or 3 as disclosed herein, wherein the resulting active peptide is present at a concentration of at least A, wherein A is 0.001 mg/ml, 0.01 mg/ml, 0.1 mg/ml, 0.5 mg/ml, 1 mg/ml, 2 mg/ml, 3 mg/ml, 4 mg/ml, 5 mg/ml, 6 mg/ml, 7 mg/ml, 8 mg/ml, 9 mg/ml, 10 mg/ml, 11 mg/ml, 12 mg/ml, 13 mg/ml, 14 mg/ml, 15 mg/ml, 16 mg/ml, 17 mg/ml, 18 mg/ml, 19 mg/ml, 20 mg/ml, 21 mg/ml, 22 mg/ml, 23 mg/ml, 24 mg/ml, 25 mg/ml or higher. In other embodiments, such compositions may contain an active peptide of Class 1, 2, or 3 at a concentration of at most B, wherein B is 30 mg/ml, 25 mg/ml, 24 mg/ml, 23, mg/ml, 22 mg/ml, 21 mg/ml, 20 mg/ml, 19 mg/ml, 18 mg/ml, 17 mg/ml, 16 mg/ml, 15 mg/ml, 14 mg/ml, 13 mg/ml, 12 mg/ml, 11 mg/ml 10 mg/ml, 9 mg/ml, 8 mg/ml, 7 mg/ml, 6 mg/ml, 5 mg/ml, 4 mg/ml, 3 mg/ml, 2 mg/ml, 1 mg/ml, or 0.1 mg/ml. In some embodiments, the compositions may contain a Class 1, 2, or 3 glucagon related peptide at a concentration range of A to B mg/ml, for example, 0.001 to 30.0 mg/ml. In some embodiments the pharmaceutical compositions comprise aqueous solutions that are sterilized and optionally stored within various containers. The compounds of the present invention can be used in accordance with some embodiments to prepare pre-formulated solutions ready for injection. In other embodiments the pharmaceutical compositions comprise a lyophilized powder. The pharmaceutical compositions can be further packaged as part of a kit that includes a disposable device for administering the composition to a patient. The containers or kits may be labeled for storage at ambient room temperature or at refrigerated temperature.

All therapeutic methods, pharmaceutical compositions, kits and other similar embodiments described herein contemplate that the prodrug compounds include all pharmaceutically acceptable salts thereof.

In some embodiments the kit is provided with a device for administering the prodrug composition to a patient. The kit may further include a variety of containers, e.g., vials, tubes, bottles, and the like. Preferably, the kits will also include instructions for use. In accordance with some embodiments the device of the kit is an aerosol dispensing device, wherein the composition is prepackaged within the aerosol device. In another embodiment the kit comprises a syringe and a needle, and in some embodiments the prodrug composition is prepackaged within the syringe.

Pharmaceutical Formulations of Class 1, 2, and 3 Glucagon Related Peptides

In accordance with some embodiments a pharmaceutical composition is provided wherein the composition comprises a glucadon peptide of the present disclosure, or pharmaceutically acceptable salt thereof, and a pharmaceutically acceptable carrier. The pharmaceutical composition can comprise any pharmaceutically acceptable ingredient, including, for example, acidifying agents, additives, adsorbents, aerosol propellants, air displacement agents, alkalizing agents, anticaking agents, anticoagulants, antimicrobial preservatives, antioxidants, antiseptics, bases, binders, buffering agents, chelating agents, coating agents, coloring agents, desiccants, detergents, diluents, disinfectants, disintegrants, dispersing agents, dissolution enhancing agents, dyes, emollients, emulsifying agents, emulsion stabilizers, fillers, film forming agents, flavor enhancers, flavoring agents, flow enhancers, gelling agents, granulating agents, humectants, lubricants, mucoadhesives, ointment bases, ointments, oleaginous vehicles, organic bases, pastille bases, pigments, plasticizers, polishing agents, preservatives, sequestering agents, skin penetrants, solubilizing agents, solvents, stabilizing agents, suppository bases, surface active agents, surfactants, suspending agents, sweetening agents, therapeutic agents, thickening agents, tonicity agents, toxicity agents, viscosity-increasing agents, water-absorbing agents, water-miscible cosolvents, water softeners, or wetting agents.

In some embodiments, the pharmaceutical composition comprises any one or a combination of the following components: acacia, acesulfame potassium, acetyltributyl citrate, acetyltriethyl citrate, agar, albumin, alcohol, dehydrated alcohol, denatured alcohol, dilute alcohol, aleuritic acid, alginic acid, aliphatic polyesters, alumina, aluminum hydroxide, aluminum stearate, amylopectin, α-amylose, ascorbic acid, ascorbyl palmitate, aspartame, bacteriostatic water for injection, bentonite, bentonite magma, benzalkonium chloride, benzethonium chloride, benzoic acid, benzyl alcohol, benzyl benzoate, bronopol, butylated hydroxyanisole, butylated hydroxytoluene, butylparaben, butylparaben sodium, calcium alginate, calcium ascorbate, calcium carbonate, calcium cyclamate, dibasic anhydrous calcium phosphate, dibasic dehydrate calcium phosphate, tribasic calcium phosphate, calcium propionate, calcium silicate, calcium sorbate, calcium stearate, calcium sulfate, calcium sulfate hemihydrate, canola oil, carbomer, carbon dioxide, carboxymethyl cellulose calcium, carboxymethyl cellulose sodium, β-carotene, carrageenan, castor oil, hydrogenated castor oil, cationic emulsifying wax, cellulose acetate, cellulose acetate phthalate, ethyl cellulose, microcrystalline cellulose, powdered cellulose, silicified microcrystalline cellulose, sodium carboxymethyl cellulose, cetostearyl alcohol, cetrimide, cetyl alcohol, chlorhexidine, chlorobutanol, chlorocresol, cholesterol, chlorhexidine acetate, chlorhexidine gluconate, chlorhexidine hydrochloride, chlorodifluoroethane (HCFC), chlorodifluoromethane, chlorofluorocarbons (CFC)chlorophenoxyethanol, chloroxylenol, corn syrup solids, anhydrous citric acid, citric acid monohydrate, cocoa butter, coloring agents, corn oil, cottonseed oil, cresol, m-cresol, o-cresol, p-cresol, croscarmellose sodium, crospovidone, cyclamic acid, cyclodextrins, dextrates, dextrin, dextrose, dextrose anhydrous, diazolidinyl urea, dibutyl phthalate, dibutyl sebacate, diethanolamine, diethyl phthalate, difluoroethane (HFC), dimethyl-β-cyclodextrin, cyclodextrin-type compounds such as Captisol®, dimethyl ether, dimethyl phthalate, dipotassium edentate, disodium edentate, disodium hydrogen phosphate, docusate calcium, docusate potassium, docusate sodium, dodecyl gallate, dodecyltrimethylammonium bromide, edentate calcium disodium, edtic acid, eglumine, ethyl alcohol, ethylcellulose, ethyl gallate, ethyl laurate, ethyl maltol, ethyl oleate, ethylparaben, ethylparaben potassium, ethylparaben sodium, ethyl vanillin, fructose, fructose liquid, fructose milled, fructose pyrogen-free, powdered fructose, fumaric acid, gelatin, glucose, liquid glucose, glyceride mixtures of saturated vegetable fatty acids, glycerin, glyceryl behenate, glyceryl monooleate, glyceryl monostearate, self-emulsifying glyceryl monostearate, glyceryl palmitostearate, glycine, glycols, glycofurol, guar gum, heptafluoropropane (HFC), hexadecyltrimethylammonium bromide, high fructose syrup, human serum albumin, hydrocarbons (HC), dilute hydrochloric acid, hydrogenated vegetable oil, type II, hydroxyethyl cellulose, 2-hydroxyethyl-β-cyclodextrin, hydroxypropyl cellulose, low-substituted hydroxypropyl cellulose, 2-hydroxypropyl-β-cyclodextrin, hydroxypropyl methylcellulose, hydroxypropyl methylcellulose phthalate, imidurea, indigo carmine, ion exchangers, iron oxides, isopropyl alcohol, isopropyl myristate, isopropyl palmitate, isotonic saline, kaolin, lactic acid, lactitol, lactose, lanolin, lanolin alcohols, anhydrous lanolin, lecithin, magnesium aluminum silicate, magnesium carbonate, normal magnesium carbonate, magnesium carbonate anhydrous, magnesium carbonate hydroxide, magnesium hydroxide, magnesium lauryl sulfate, magnesium oxide, magnesium silicate, magnesium stearate, magnesium trisilicate, magnesium trisilicate anhydrous, malic acid, malt, maltitol, maltitol solution, maltodextrin, maltol, maltose, mannitol, medium chain triglycerides, meglumine, menthol, methylcellulose, methyl methacrylate, methyl oleate, methylparaben, methylparaben potassium, methylparaben sodium, microcrystalline cellulose and carboxymethylcellulose sodium, mineral oil, light mineral oil, mineral oil and lanolin alcohols, oil, olive oil, monoethanolamine, montmorillonite, octyl gallate, oleic acid, palmitic acid, paraffin, peanut oil, petrolatum, petrolatum and lanolin alcohols, pharmaceutical glaze, phenol, liquified phenol, phenoxyethanol, phenoxypropanol, phenylethyl alcohol, phenylmercuric acetate, phenylmercuric borate, phenylmercuric nitrate, polacrilin, polacrilin potassium, poloxamer, polydextrose, polyethylene glycol, polyethylene oxide, polyacrylates, polyethylene-polyoxypropylene-block polymers, polymethacrylates, polyoxyethylene alkyl ethers, polyoxyethylene castor oil derivatives, polyoxyethylene sorbitol fatty acid esters, polyoxyethylene stearates, polyvinyl alcohol, polyvinyl pyrrolidone, potassium alginate, potassium benzoate, potassium bicarbonate, potassium bisulfite, potassium chloride, postassium citrate, potassium citrate anhydrous, potassium hydrogen phosphate, potassium metabisulfite, monobasic potassium phosphate, potassium propionate, potassium sorbate, povidone, propanol, propionic acid, propylene carbonate, propylene glycol, propylene glycol alginate, propyl gallate, propylparaben, propylparaben potassium, propylparaben sodium, protamine sulfate, rapeseed oil, Ringer's solution, saccharin, saccharin ammonium, saccharin calcium, saccharin sodium, safflower oil, saponite, serum proteins, sesame oil, colloidal silica, colloidal silicon dioxide, sodium alginate, sodium ascorbate, sodium benzoate, sodium bicarbonate, sodium bisulfite, sodium chloride, anhydrous sodium citrate, sodium citrate dehydrate, sodium chloride, sodium cyclamate, sodium edentate, sodium dodecyl sulfate, sodium lauryl sulfate, sodium metabisulfite, sodium phosphate, dibasic, sodium phosphate, monobasic, sodium phosphate, tribasic, anhydrous sodium propionate, sodium propionate, sodium sorbate, sodium starch glycolate, sodium stearyl fumarate, sodium sulfite, sorbic acid, sorbitan esters (sorbitan fatty esters), sorbitol, sorbitol solution 70%, soybean oil, spermaceti wax, starch, corn starch, potato starch, pregelatinized starch, sterilizable maize starch, stearic acid, purified stearic acid, stearyl alcohol, sucrose, sugars, compressible sugar, confectioner's sugar, sugar spheres, invert sugar, Sugartab, Sunset Yellow FCF, synthetic paraffin, talc, tartaric acid, tartrazine, tetrafluoroethane (HFC), theobroma oil, thimerosal, titanium dioxide, alpha tocopherol, tocopheryl acetate, alpha tocopheryl acid succinate, beta-tocopherol, delta-tocopherol, gamma-tocopherol, tragacanth, triacetin, tributyl citrate, triethanolamine, triethyl citrate, trimethyl-β-cyclodextrin, trimethyltetradecylammonium bromide, tris buffer, trisodium edentate, vanillin, type I hydrogenated vegetable oil, water, soft water, hard water, carbon dioxide-free water, pyrogen-free water, water for injection, sterile water for inhalation, sterile water for injection, sterile water for irrigation, waxes, anionic emulsifying wax, carnauba wax, cationic emulsifying wax, cetyl ester wax, microcrystalline wax, nonionic emulsifying wax, suppository wax, white wax, yellow wax, white petrolatum, wool fat, xanthan gum, xylitol, zein, zinc propionate, zinc salts, zinc stearate, or any excipient in the *Handbook of Pharmaceutical Excipients,* Third Edition, A. H. Kibbe (Pharmaceutical Press, London, UK, 2000), which is incorporated by reference in its entirety. *Remington's Pharmaceutical Sciences,* Sixteenth Edition, E. W. Martin (Mack Publishing Co., Easton, Pa., 1980), which is incorporated by reference in its entirety, discloses various components used in formulating pharmaceutically acceptable compositions and known techniques for the preparation thereof. Except insofar as any conventional agent is incompatible with the pharmaceutical compositions, its use in pharmaceutical compositions is contemplated. Supplementary active ingredients also can be incorporated into the compositions.

The pharmaceutical formulations disclosed herein may be designed to be short-acting, fast-releasing, long-acting, or sustained-releasing as described below. The pharmaceutical formulations may also be formulated for immediate release, controlled release or for slow release. The instant compositions may further comprise, for example, micelles or liposomes, or some other encapsulated form, or may be administered in an extended release form to provide a prolonged storage and/or delivery effect. The disclosed pharmaceutical formulations may be administered according to any regime including, for example, daily (1 time per day, 2 times per day, 3 times per day, 4 times per day, 5 times per day, 6 times per day), every two days, every three days, every four days, every five days, every six days, weekly, bi-weekly, every three weeks, monthly, or bi-monthly.

In some embodiments, the foregoing component(s) may be present in the pharmaceutical composition at any concentration, such as, for example, at least A, wherein A is 0.0001% w/v, 0.001% w/v, 0.01% w/v, 0.1% w/v, 1% w/v, 2% w/v, 5% w/v, 10% w/v, 20% w/v, 30% w/v, 40% w/v, 50% w/v, 60% w/v, 70% w/v, 80% w/v, or 90% w/v. In some embodiments, the foregoing component(s) may be present in the pharmaceutical composition at any concentration, such as, for example, at most B, wherein B is 90% w/v, 80% w/v, 70% w/v, 60% w/v, 50% w/v, 40% w/v, 30% w/v, 20% w/v, 10% w/v, 5% w/v, 2% w/v, 1% w/v, 0.1% w/v, 0.001% w/v, or 0.0001%. In other embodiments, the foregoing component(s) may be present in the pharmaceutical composition at any concentration range, such as, for example from about A to about B. In some embodiments, A is 0.0001% and B is 90%.

The pharmaceutical compositions may be formulated to achieve a physiologically compatible pH. In some embodiments, the pH of the pharmaceutical composition may be at least 5, at least 5.5, at least 6, at least 6.5, at least 7, at least 7.5, at least 8, at least 8.5, at least 9, at least 9.5, at least 10, or at least 10.5 up to and including pH 11, depending on the formulation and route of administration. In certain embodiments, the pharmaceutical compositions may comprise buffering agents to achieve a physiological compatible pH. The buffering agents may include any compounds capabale of buffering at the desired pH such as, for example, phosphate buffers (e.g. PBS), triethanolamine, Tris, bicine, TAPS, tricine, HEPES, TES, MOPS, PIPES, cacodylate, MES, and others. In certain embodiments, the strength of the buffer is at least 0.5 mM, at least 1 mM, at least 5 mM, at least 10 mM, at least mM, at least 30 mM, at least 40 mM, at least 50 mM, at least 60 mM, at least 70 mM, at least 80 mM, at least 90 mM, at least 100 mM, at least 120 mM, at least 150 mM, or at least 200 mM. In some embodiments, the strength of the buffer is no more than 300 mM (e.g. at most 200 mM, at most 100 mM, at most 90 mM, at most 80 mM, at most 70 mM, at most 60 mM, at most 50 mM, at most 40 mM, at most 30 mM, at most 20 mM, at most 10 mM, at most mM, at most 1 mM).

The prodrug compounds disclosed herein may be prepared by standard synthetic methods, recombinant DNA techniques, or any other methods of preparing peptides and fusion proteins. Although certain non-natural amino acids cannot be expressed by standard recombinant DNA techniques, techniques for their preparation are known in the art. Compounds of this invention that encompass non-peptide portions may be synthesized by standard organic chemistry reactions, in addition to standard peptide chemistry reactions when applicable.

EXAMPLES

General Pegylation Protocol: (Cys-maleimido)

Typically, the glucagon related peptide containing Cys is dissolved in phosphate buffered saline (5-10 mg/ml) and 0.01 Methylenediamine tetraacetic acid is added (10-15% of total volume). Excess (2-fold) maleimido methoxyPEG reagent (Dow) is added and the reaction stirred at room temperature while monitoring reaction progress by high performance liquid chromatography (HPLC). After 8-24 hrs, the reaction mixture is acidified and loaded onto a preparative reverse phase column for purification using 0.1% tetrafluoroacetic acid (TFA)/acetonitrile in the gradient mode. The appropriate fractions were combined and lyophilized to give the desired pegylated derivatives.

Example 1

Dipeptide Cleavage Half Time (in PBS) Determination on Model Peptide

A model hexapeptide (HSRGTF-NH$_2$; SEQ ID NO:715) was used as a model to determine the half life of various dipeptides linked to the hexapeptide through an amide bond. The hexapeptide was assembled on a peptide synthesizer. To confirm the integrity of the synthesis and the availability of an extendable N-terminus, the peptide-bound resin was cleaved by hydrofluoric acid (HF) and analyzed. Then Boc-protected sarcosine and lysine were successively introduced to the peptide-bound resin to produce peptide A (dipeptide+model peptide). Peptide A was cleaved by HF and purified by preparative HPLC.

Preparative Purification Using HPLC:

Purification was performed using HPLC analysis on a silica based 1×25 cm Vydac C18 (5μ particle size, 300 A° pore size) column. The instruments used were: Waters Associates model 600 pump, Injector model 717, and UV detector model 486. A wavelength of 230 nm was used for all samples. Solvent A contained 10% CH$_3$CN/0.1% TFA in distilled water, and solvent B contained 0.1% TFA in CH$_3$CN. A linear gradient was employed (0 to 100% B in 2 hours). The flow rate was 10 mL/min and the fraction size was 4 mL. From about 150 mg of crude peptide, 30 mg of the pure peptide (about 20% yield) was typically obtained.

Peptide A was dissolved at 1 mg/mL concentration in phosphate buffered saline (PBS) buffer (PH 7.4). Then it was incubated at 37° C. in a water bath. The analytical samples were collected at different time points (5 h, 8 h, 24 h, 31 h, 47 h) and quenched by the same volume of 0.1% TFA. HPLC was used to monitor the cleavage reaction. The data were qualitatively monitored by liquid chromatography-mass spectrometry (LC-MS) and quantitatively analyzed by HPLC Peak Simple Chromatography software to obtain the retention time and relative peak area for the prodrug modification.

Analysis Using Mass Spectrometry

The mass spectra were obtained using a Sciex API-III electrospray quadrapole mass spectrometer with a standard electron spray ionization (ESI) ion source. Ionization conditions that were used are as follows: ESI in the positive-ion mode; ion spray voltage, 3.9 kV; orifice potential, 60 V. The nebulizing and curtain gas used was nitrogen at a flow rate of 0.9 L/min. Mass spectra were recorded from 600-1800 Thompsons (Th) at 0.5 Th per step and 2 msec dwell time. The sample (about 1 mg/mL) was dissolved in 50% aqueous acetonitrile with 1% acetic acid and introduced by an external syringe pump at the rate of 5 μL/min.

When the peptides were analyzed in PBS solution by ESI-MS, they were first desalted using a ZipTip solid phase extraction tip containing 0.6 μL C4 resin, according to instructions provided by the manufacturer (Millipore Corporation, Billerica, Mass., see http://www.millipore.com/catalogue.nsf/docs/C5737).

Analysis Using HPLC

The HPLC analyses were performed using a Beckman System Gold Chromatography system using a UV detector at 214 nm and a 150 mm×4.6 mm C8 Vydac column. The flow rate was 1 mL/min. Solvent A contained 0.1% TFA in distilled water, and solvent B contained 0.1% TFA in 90% CH$_3$CN. A linear gradient was employed (0% to 30% B in 10 minutes). The data were collected and analyzed using Peak Simple Chromatography software.

The initial rates of cleavage were used to measure the rate constant for the dissociation of the respective prodrugs. The concentrations of the prodrug and the drug were estimated from their peak areas, 'a' and 'b' respectively, for each of the different collection times (see Table 1). The first order dissociation rate constants of the prodrugs were determined by plotting the logarithm of the concentration of the prodrug at various time intervals. The slope of this plot gives the rate constant 'k'. The half lives of the degradation of the various prodrugs were then calculated by using the formula $t_{1/2}=0.693/k$.

TABLE 1

HPLC and LC-MS data of Cleavage of A peptide (lys-sar-HSRGTF-NH$_2$) in PBS

|  | 5 h | | 8 h | | 24 h | | 31 h | | 47 h | |
| --- | --- | --- | --- | --- | --- | --- | --- | --- | --- | --- |
| HPLC peaks | a | b | a | b | a | b | a | b | a | b |
| Retention time(min) | 4.3 | 4.8 | 4.2 | 4.7 | 4.3 | 4.8 | 4.3 | 4.8 | 4.3 | 4.8 |
| Molecular weight | 702 | 902 | 702 | 902 | 702 | 902 | 702 | 902 | 702 | 902 |
| Relative peak area(%) | 26.5 | 73.5 | 28.9 | 71.1 | 28.8 | 71.2 | 77.7 | 22.3 | 90.0 | 10.0 |

The half lives of the degradation of the various prodrugs were calculated by using the formula $t_{1/2}=0.693/k$ and the half life of the lys-sar combination on model peptide HSRGTF-NH$_2$ (SEQ ID NO: 715) was determined to be 14.0 h.

Example 2

Dipeptide Cleavage Half Time (in Plasma) Determination on D-Model Peptide

Another model hexapeptide (dHdTdRGdTdF-NH$_2$ SEQ ID NO: 716) was used as a model to determine the half-life of dipeptides combination in plasma. D amino acids were used to prevent other enzymatic cleavage of the model peptide except for prodrug cleavage. The hexapeptide was synthesized by auto-synthesizer. To confirm that a feasible extended N-terminus could be used for the prodrug modification, the peptide-bound resin was cleaved by HF to check the validity. Then Boc-protected sarcosine and lysine were successively introduced to the peptide-bound resin. The peptide B (dipeptide+d-model peptide) was cleaved by HF and purified by preparative HPLC.

Preparative Purification Using HPLC:

Purification was performed using HPLC analysis on a silica based 1×25 cm Vydac C18 (5μ particle size, 300 A° pore size) column. The instruments used were: Waters Associates model 600 pump, Injector model 717, and UV detector model 486. A wavelength of 230 nm was used for all samples. Solvent A contained 10% $CH_3CN$/0.1% TFA in distilled water, and solvent B contained 0.1% TFA in $CH_3CN$. A linear gradient was employed (0 to 100% B in 2 hours). The flow rate was 10 mL/min and the fraction size was 4 mL. From about 150 mg of crude peptide, 30 mg of the pure peptide (about 20% yield) was typically obtained.

Peptide B was dissolved at 2 mg/mL concentration in plasma (pH 7.4). Then it was incubated in a 37° C. water bath. The analytical samples were collected at different time points (5 h, 11 h, 24 h, 32 h, 48 h). The samples were treated by 10-fold volume of 0.1% TFA/ACN and centrifuged at 3000 rpm. The supernatant fluid was collected and diluted with the same volume of 0.1% TFA/$H_2O$. HPLC was used to monitor the cleavage reaction. The data were qualitatively monitored by LC-MS and quantitatively analyzed by HPLC Peak Simple Chromatography software to obtain the retention time and relative peak area.

Analysis Using Mass Spectrometry

The mass spectra were obtained using a Sciex API-III electrospray quadrapole mass spectrometer with a standard ESI ion source. Ionization conditions that were used are as follows: ESI in the positive-ion mode; ion spray voltage, 3.9 kV; orifice potential, 60 V. The nebulizing and curtain gas used was nitrogen at a flow rate of 0.9 L/min. Mass spectra were recorded from 600-1800 Thompsons at 0.5 Th per step and 2 msec dwell time. The sample (about 1 mg/mL) was dissolved in 50% aqueous acetonitrile with 1% acetic acid and introduced by an external syringe pump at the rate of 5 μL/min.

Analysis Using HPLC

The HPLC analyses were performed using a Beckman System Gold Chromatography system using a UV detector at 214 nm and a 150 mm×4.6 mm C8 Vydac column. The flow rate was 1 mL/min. Solvent A contained 0.1% TFA in distilled water, and solvent B contained 0.1% TFA in 90% $CH_3CN$. A linear gradient was employed (0% to 30% B in 10 minutes). The data were collected and analyzed using Peak Simple Chromatography software.

The initial rates of cleavage were used to measure the rate constant for the dissociation of the respective prodrugs. The concentrations of the prodrug and the drug were estimated from their peak areas, 'a' and 'b' respectively, for each of the different collection times (see Table 2). The first order dissociation rate constants of the prodrugs were determined by plotting the logarithm of the concentration of the prodrug at various time intervals. The slope of this plot gives the rate constant 'k'. The half lives of the degradation of the various prodrugs were then calculated by using the formula $t_{1/2}=0.693/k$.

TABLE 2

| | HPLC and LC-MS data of Cleavage of B peptide (lys-sar-dHdTdRGdTdF-$NH_2$) in plasma | | | | | | | | |
|---|---|---|---|---|---|---|---|---|---|
| | 5 h | | 11 h | | 24 h | | 32 h | | 48 h | |
| HPLC peaks | a | b | a | b | a | B | a | b | a | b |
| Retention time(min) | 5.7 | 6.2 | 5.8 | 6.3 | 5.7 | 6.2 | 5.7 | 6.2 | 5.7 | 6.2 |
| Molecular weight | 702 | 902 | 702 | 902 | 702 | 902 | 702 | 902 | 702 | 902 |
| Relative peak area(%) | 17.0 | 83.0 | 29.2 | 70.8 | 60.2 | 39.8 | 54.0 | 46.0 | 27.6 | 72.4 |

The half lives of the degradation of the various prodrugs were then calculated by using the formula $t_{1/2}=0.693/k$. Using this formula, the half life of Lys-Sar combination in plasma on a D-model peptide dHdTdRGdTdF-$NH_2$ (SEQ ID NO: 716) was determined to be 18.6 h.

Example 3

The cleavage half lives of various additional dipeptides linked to the model hexapeptide (HSRGTF-$NH_2$; SEQ ID NO: 715) were determined using the procedures described in Example 1. The data generated in these experiments is presented in Tables 3 and 4.

TABLE 3

Cleavage of the Dipeptides A—B that are linked to the side chain of an N-terminal para-amino-Phe from the Model HexaPeptides in PBS

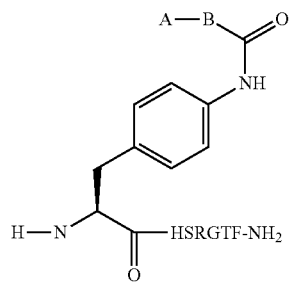

| Compounds | A (amino acid) | B (amino acid) | $t_{1/2}$ |
|---|---|---|---|
| 1 | F | P | 58 h |
| 2 | Hydroxyl-F | P | 327 h |
| 3 | d-F | P | 20 h |
| 4 | d-F | d-P | 39 h |
| 5 | G | P | 72 h |
| 6 | Hydroxyl-G | P | 603 h |
| 7 | L | P | 62 h |
| 8 | tert-L | P | 200 h |
| 9 | S | P | 34 h |
| 10 | P | P | 97 h |
| 11 | K | P | 33 h |

TABLE 3-continued

Cleavage of the Dipeptides A—B that are linked to the side chain of an N-terminal para-amino-Phe from the Model HexaPeptides in PBS

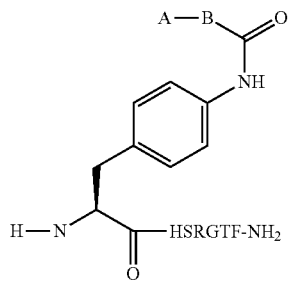

| Compounds | A (amino acid) | B (amino acid) | $t_{1/2}$ |
|---|---|---|---|
| 12 | dK | P | 11 h |
| 13 | E | P | 85 h |
| 14 | Sar | P | about 1000 h |
| 15 | Aib | P | 69 min |
| 16 | Hydroxyl-Aib | P | 33 h |
| 17 | cyclohexane | P | 6 min |
| 18 | G | G | No cleavage |
| 19 | Hydroxyl-G | G | No cleavage |
| 20 | S | N-Methyl-Gly | 4.3 h |
| 21 | K | N-Methyl-Gly | 5.2 h |
| 22 | Aib | N-Methyl-Gly | 7.1 min |
| 23 | Hydroxyl-Aib | N-Methyl-Gly | 1.0 h |

TABLE 4

Cleavage of the Dipeptides A-B linked to variable amino acids at position 1 ($X_1$) from the Model Hexapeptide ($X_1$-SRGTF-NH$_2$ (SEQ ID NO: 732)) in PBS NH$_2$-A—B—$X_1$-SRGTF-NH$_2$

| Compounds | A (amino acid) | B (amino acid) | $X_1$ (amino acid) | $t_{1/2}$ |
|---|---|---|---|---|
| 1 | F | P | H | No cleavage |
| 2 | Hydroxyl-F | P | H | No cleavage |
| 3 | G | P | H | No cleavage |
| 4 | Hydroxyl-G | P | H | No cleavage |
| 5 | A | P | H | No cleavage |
| 6 | C | P | H | No cleavage |
| 7 | S | P | H | No cleavage |
| 8 | P | P | H | No cleavage |
| 9 | K | P | H | No cleavage |
| 10 | E | P | H | No cleavage |
| 11 | Dehydro V | P | H | No cleavage |
| 12 | P | d-P | H | No cleavage |
| 13 | d-P | P | H | No cleavage |
| 14 | Aib | P | H | 32 h |
| 15 | Aib | d-P | H | 20 h |
| 16 | Aib | P | d-H | 16 h |
| 17 | Cyclohexyl- | P | H | 5 h |
| 18 | Cyclopropyl- | P | H | 10 h |
| 19 | N—Me-Aib | P | H | >500 h |
| 20 | α,α-diethyl-Gly | P | H | 46 h |
| 21 | Hydroxyl-Aib | P | H | 61 h |
| 22 | Aib | P | A | 58 h |
| 23 | Aib | P | N-Methyl-His | 30 h |
| 24 | Aib | N-Methyl-Gly | H | 49 min |
| 25 | Aib | N-Hexyl-Gly | H | 10 min |
| 26 | Aib | Azetidine-2-carboxylic acid | H | >500 h |
| 27 | G | N-Methyl-Gly | H | 104 h |
| 28 | Hydroxyl-G | N-Methyl-Gly | H | 149 h |
| 29 | G | N-Hexyl-Gly | H | 70 h |
| 30 | dK | N-Methyl-Gly | H | 27 h |
| 31 | dK | N-Methyl-Ala | H | 14 h |
| 32 | dK | N-Methyl-Phe | H | 57 h |
| 33 | K | N-Methyl-Gly | H | 14 h |

TABLE 4-continued

Cleavage of the Dipeptides A-B linked to variable amino acids at position 1 ($X_1$) from the Model Hexapeptide ($X_1$-SRGTF-NH$_2$ (SEQ ID NO: 732)) in PBS NH$_2$-A—B—$X_1$-SRGTF-NH$_2$

| Compounds | A (amino acid) | B (amino acid) | $X_1$ (amino acid) | $t_{1/2}$ |
|---|---|---|---|---|
| 34 | F | N-Methyl-Gly | H | 29 h |
| 35 | S | N-Methyl-Gly | H | 17 h |
| 36 | P | N-Methyl-Gly | H | 181 h |

Example 4

Synthesis of Glucagon and GLP-1 Analogs

To investigate the possibility of preparing a bioactive derivative of glucagon and GLP-1, numerous peptide analogs were synthesized. The standard procedure is described briefly here, and the details are discussed later.

Materials:

PAM resin (PAM resin is OCH$_2$-phenylacetamidomethyl-copolystyrene-1% divinylbenzene), (100-180 mesh, 1% DVB cross-linked polystyrene; loading of 0.7-1.0 mmol/g), Boc-protected and Fmoc protected amino acids were purchased from Midwest Biotech. Other reagents such as the α-hydroxy-acids (phenyllactic acid and glycolic acid) were purchased from Aldrich. The solid phase peptide syntheses using Boc-protected amino acids were performed on an Applied Biosystem 430A Peptide Synthesizer. Fmoc protected amino acid synthesis was performed using the Applied Biosystems Model 433 Peptide Synthesizer. The manual synthesis of depsi-peptides was performed in sintered reaction vessels using analogous procedures (Schnolzer, M., et al., (1992) Int J Pept Protein Res 40(3-4):180-193).

Peptide Synthesis (Boc Amino Acids/HF Cleavage):

Synthesis of these analogs was performed on the Applied Biosystem Model 430A Peptide Synthesizer. Synthetic peptides were constructed by sequential addition of amino acids, and activated esters of each amino acid were generated by the addition of 1.9 mmol (3.8 mL of a 0.5 M solution) of 3-(Di-ethoxy-phosphoryloxy)-3H-benzo[d][1,2,3]triazin-4-one (DEPBT) in DMF to a cartridge containing 2 mmol of Boc protected amino acid. The amino acids were dissolved by bubbling nitrogen gas through the cartridge. One mL of N,N-Diisopropylethylamine was added to the cartridge to effect ester formation. This solution was transferred to the reaction vessel containing the 0.2 mmol of the C-terminal residue attached to the PAM resin, vortexed several times, and allowed to couple to the resin for 10 minutes. After washing to remove the unreacted reagents, the N-terminal Boc protecting group was removed by treatment with trifluoroacetic acid (TFA) for 5 minutes. The resin was washed with DMF and the cycle was repeated for the desired number of steps until the chain was assembled. The reaction vessel at the end of the synthesis (typically 30 amino acids) contained approximately 1.2-1.5 g of protected peptidyl-PAM resin. The resin was washed numerous times with dimethylformamide (DMF), treated with trifluoroacetic acid to remove the last t-Boc protecting group and finally washed several additional times with DMF, dichloromethane (DCM) and dried.

The peptidyl-resin was treated with anhydrous HF (procedure detailed later in this section), and this typically yielded approximately 350 mg (about 50% yield) of a crude deprotected-peptide.

Peptide Synthesis (Fmoc Amino Acids/HF Cleavage):

This synthesis scheme was performed manually with a few amino acids at selective sites. In this work, the Fmoc amino acids were used only to synthesize internal serine prodrugs, as a part of a wider synthetic strategy. Here, it is to be noted that although Fmoc chemistry has been used in the synthesis, the peptides have always been built on PAM resin that required treatment with HF to cleave the peptide from the solid support. The yield of these peptides is approximately as stated earlier for Boc/PAM synthesis.

The synthesis was carried out as described in the previous section. At the end of the coupling step, the peptidyl-resin was treated with 20% piperidine to remove the N-terminal Fmoc protecting group. It was washed repeatedly with DMF and this repetitive cycle was repeated for the desired number of coupling steps. The peptidyl-resin at the end of the entire synthesis was dried by using DCM, and the peptide was cleaved from the resin with anhydrous HF.

Depsi-Peptide Synthesis (Amino Ester Formation)

In this case, the peptidyl-resin had an α-hydroxyl-N terminal extension instead of a N-terminal amine and the acylation was done at the α-hydroxyl group. This reaction takes a longer time than that of the amide bond formation because the hydroxyl group is a weaker nucleophile as compared to the amine. The reaction time was typically 12 hours.

Initially, the activated esters of each amino acid were generated by the addition of 1 mmol (0.155 mL of Diisopropylcarbodiimide (DIC) to a cartridge containing a solution of 2 mmol of Boc protected amino acid residue in 2 mL DCM. This cartridge was cooled to 10° C. for 10 minutes and 0.9 mmol (244 mg) of dimethylaminopyridine (DMAP) was added to the cartridge to accelerate ester formation. This mixture was transferred to the reaction vessel containing the peptidyl-resin upon which the peptide was synthesized. The reaction vessel was stirred for 12 hours.

The peptidyl-resin was dried using DCM and the synthesis of the desired peptide was continued. The peptidyl-resin at the end of the entire synthesis was dried by using DCM, and finally treated with anhydrous HF to generate the desired peptide.

N-Terminal Hydroxyl Peptide Synthesis (α-Hydroxyl-N Terminal Extension)

In this reaction, the free amine of the peptidyl-resin reacts with an α-hydroxyl acid to form an α-hydroxyl-N terminal extension. In this regard, two such α-hydroxyl acids were used namely, glycolic acid (OH-glycine) and phenyllactic acid (OH-phenylalanine). These syntheses were also performed manually. The peptides were constructed by addition of the α-hydroxyl acid, and activated esters of the α-hydroxyl acid were generated by the addition of 0.9 mmol of DEPBT (270 mg) to a cartridge containing a solution of 1 mmol of Boc protected residue in 2 mL DMF. DIEA (N,N-Diisopropylethylamine, 0.5 mL) was added to the cartridge to accelerate ester formation. This mixture was transferred to the reaction vessel containing the peptidyl-resin upon which the peptide was synthesized. The reaction time was 6 hours.

The peptidyl-resin was dried using DCM and the synthesis of the desired peptide was continued. The peptidyl-resin at the end of the entire synthesis was dried by using DCM, and cleaved by anhydrous HF to generate the free peptide.

HF Treatment of the Peptidyl-Resin

The peptidyl-resin (30 mg to 200 mg) was placed in the hydrogen fluoride (HF) reaction vessel for cleavage. 500 μL of p-cresol was added to the vessel as a carbonium ion scavenger. The vessel was attached to the HF system and submerged in a methanol/dry ice mixture. The vessel was evacuated with a vacuum pump and 10 mL of HF was distilled to the reaction vessel. This reaction mixture of the peptidyl-resin and the HF was stirred for one hour at 0° C., after which a vacuum was established and the HF was quickly evacuated (10-15 min). The vessel was removed carefully and filled with approximately 35 mL of ether to precipitate the peptide and to extract the p-cresol and small molecule organic protecting groups resulting from HF treatment. This mixture was filtered utilizing a teflon filter and repeated twice to remove all excess cresol. This filtrate was discarded. The precipitated peptide dissolved in approximately 20 mL of 10% acetic acid (aq). This filtrate, which contained the desired peptide, was collected and lyophilized.

Analysis Using Mass Spectrometry

The mass spectra were obtained using a Sciex API-III electrospray quadrapole mass spectrometer with a standard ESI ion source. Ionization conditions that were used are as follows: ESI in the positive-ion mode; ion spray voltage, 3.9 kV; orifice potential, 60 V. The nebulizing and curtain gas used was nitrogen with a flow rate of 0.9 L/min. Mass spectra were recorded from 600-1800 Thompsons at 0.5 Th per step and 2 msec dwell time. The sample (about 1 mg/mL) was dissolved in 50% aqueous acetonitrile with 1% acetic acid and introduced by an external syringe pump at the rate of 5 μL/min.

When the peptides were analyzed in PBS solution by ESI-MS, they were first desalted using a ZipTip solid phase extraction tip containing 0.6 μL C4 resin, according to instructions provided by the manufacturer (Millipore Corporation, Billerica, Mass., see the Millipore website of the world wide web at millipore.com/catalogue.nsf/docs/C5737).

High Performance Liquid Chromatography (HPLC) Analysis:

Preliminary analyses were performed with these crude peptides for an approximation of their relative conversion rates in Phosphate Buffered Saline (PBS) buffer (pH, 7.2) using high performance liquid chromatography (HPLC) and MALDI analysis. The crude peptide samples were dissolved in the PBS buffer at a concentration of 1 mg/mL. One mL of the resulting solution was stored in a 1.5 mL HPLC vial, which was then sealed and incubated at 37° C. Aliquots of 100 μL were drawn out at various time intervals, cooled to room temperature and analyzed by HPLC.

The HPLC analyses were performed using a Beckman System Gold Chromatography system using a UV detector at 214 nm. HPLC analyses were performed on a 150 mm×4.6 mm C18 Vydac column. The flow rate was 1 mL/min. Solvent A contained 0.1% TFA in distilled water, and solvent B contained 0.1% TFA in 90% $CH_3CN$. A linear gradient was employed (40% to 70% B in 15 minutes). The data were collected and analyzed using Peak Simple Chromatography software.

The initial rates of hydrolysis were used to measure the rate constant for the dissociation of the respective prodrugs. The concentrations of the prodrug and the drug were estimated from their peak areas respectively. The first order dissociation rate constants of the prodrugs were determined by plotting the logarithm of the concentration of the prodrug at various time intervals. The slope of this plot gives the rate constant 'k'. The half lives of the degradation of the various prodrugs were then calculated by using the formula $t_{1/2}=0.693/k$.

Preparative Purification Using HPLC:

Once a prodrug displaying an appropriate $t_{1/2}$ was identified, the prodrug was purified. The purification was performed using HPLC analysis on a silica based 1×25 cm Vydac C18 (5μ particle size, 300 A° pore size) column. The instruments used were: Waters Associates model 600 pump, Injector model 717, and UV detector model 486. A wavelength of 214 nm was used for all samples. Solvent A contained 10% CH₃CN/0.1% TFA in distilled water, and solvent B contained 0.1% TFA in CH₃CN. A linear gradient was employed (0 to 100% B in 2 hours). The flow rate was 1.2 mL/min and the fraction size was 6 mL. From about 350 mg of crude peptide, 80 mg of the pure peptide (about 23% yield) was typically obtained.

Example 5

Bioassay Experimental Design: Luciferase-Based Reporter Gene Assay for cAMP Detection The ability of each glucagon and GLP-1 analog or prodrug to induce cAMP was measured in a firefly luciferase-based reporter assay. The cAMP production that is induced is directly proportional to the glucagon or GLP-1 binding to its receptor. HEK293 cells co-transfected with the glucagon or GLP-1 receptor, respectively, and luciferase gene linked to a cAMP responsive element were employed for the bioassay.

The cells were serum-deprived by culturing 16 hours in Dulbecco Minimum Essential Medium (Invitrogen, Carlsbad, Calif.) supplemented with 0.25% Bovine Growth Serum (HyClone, Logan, Utah) and then incubated with serial dilutions of either GLP-1 analogs or prodrugs for 5 hours at 37° C., 5% $CO_2$ in 96 well poly-D-Lysine-coated "Biocoat" plates (BD Biosciences, San Jose, Calif.). At the end of the incubation, 100 µL of LucLite luminescence substrate reagent (Perkin Elmer, Wellesley, Mass.) were added to each well. The plate was shaken briefly, incubated 10 min in the dark and light output was measured on MicroBeta-1450 liquid scintillation counter (Perkin-Elmer, Wellesley, Mass.). The effective 50% concentrations ($EC_{50}$) were calculated by using Origin software (OriginLab, Northampton, Mass.).

Example 6

Bioactivity of Glucagon Related Peptide Amide-Based Prodrugs

I) GLP-1

The $C^{24}$ GLP-1(7-36) peptide (HAEGTFTSDVSSYLEGQAAKEFICWLVKGR; SEQ ID NO: 717) was assembled on a peptide synthesizer. To confirm that a feasible extended N-terminus could be used for the prodrug modification, a small percentage of peptide bound resin was cleaved by HF to check the validity of the synthesis. The synthesized peptide has a mass of 3329.8 Daltons. The receptor binding activity of GLP-1 was determined in the GLP-1-receptor Luciferase assay described in Example 5.

II) Adding Dipeptides to the N Terminus of GLP

Dipeptides were covalently attached to the N-terminus of glucagon or GLP-1 to study differential tendencies for intramolecular cyclization and cleavage through diketopiperazine (DKP) formation.

The biologically inactive dipeptide-extended GLP-1 and glucagon analogs were converted to the active peptide drug upon cleavage of the amide bond along with formation of DKP. The same conversion can be performed with either sarcosine (Sar) or proline as amino acid 'B' in the A-B dipeptide of GLP-1 analogs. Prodrugs of varying half lives were envisioned by chemically modifying the substituents on the alpha carbons of the first (A) and second (B) amino acids of the dipeptide of Formula I. For example, a dipeptide prodrug element comprising proline and amino-isobutyric acid (Aib) were successively introduced to the $C^{24}$ GLP (SEQ ID NO: 717), so the first peptide was named $Aib^{-1}-P^0,C^{24}GLP(7\text{-}36)$ where the first amino acid (amino acid "$Xaa^{-1}$") of the peptide is amino-isobutyric acid and the second amino acid (amino acid "$Xaa^0$") is proline. All peptides mentioned hereafter will have the same systematic nomenclature. The stereochemistry for each synthesized compound is the L-isomer unless otherwise stated, when amino acids are designated with a superscript position number following the three letter amino acid code. The peptide was prepared synthetically by solid phase synthesis as described earlier. The synthesis was confirmed by ESI-MS analysis (3479.9 Da).

III) GLP-Prodrug Pegylation

Pegylation is a useful method to protect peptides and decrease clearance of the peptide by the kidneys. Accordingly, for the following experiments the prodrug $Aib^{-1}-P^0,C^{24}GLP(7\text{-}36)$ was pegylated by maleimido-functioned 40 k Da PEG on the —SH group of the 24-Cys of the $Aib^{-1}-P^0,C^{24}GLP(7\text{-}36)$ through a Michael reaction. The pegylated glucagon related peptide was named 40 k $PEG\text{-}Aib^{-1}-P^0,C^{24}GLP(7\text{-}36)$. This pegylated peptide was purified by preparative HPLC and confirmed by MALDI-TOF-MS (44000-46000, broad peak).

IV) GLP-1 Activity in PBS

To explore the possible formation of DKP and simultaneous regeneration of the parent drug, 40 k $PEG\text{-}Aib^{-1}-P^0,C^{24}GLP(7\text{-}36)$ was incubated in PBS buffer at 37° C. for approximately 10 days. Samples were collected at different time points (30 h, 54 h, 168 h, 240 h). To investigate the restored activity of GLP-1 after cleavage of the dipeptide prodrug through DKP formation, all the collected samples were analyzed using a bioassay. More particularly, the receptor binding activity of GLP prodrugs were determined in the GLP-receptor Luciferase assay described in Example 5.

TABLE 5

Bioassay data at different time point of 40 kPEG-$Aib^{-1}-P^0,C^{24}GLP(7\text{-}36)$ in PBS

|  | GLP-STD | GLP-pro-30 h | GLP-pro-54 h | GLP-pro-168 h | GLP-pro-240 h |
| --- | --- | --- | --- | --- | --- |
| $EC_{50\%}$ | 0.20902 | 1.2079 | 0.75357 | 0.37388 | 0.31436 |
| $EC_{50\%}$/STD ratio | 1 | 17.31% | 27.74% | 55.90% | 66.49% |

The half life of the degradation of the parent drug 40 k $PEG\text{-}Aib^{-1}-P^0,C^{24}GLP(7\text{-}36)$ in plasma was then calculated by using the formula $t_{1/2}=0.693/k$ and determined to be 140 h.

V) GLP-1 Activity in Plasma

To explore the possible formation of DKP and simultaneous regeneration of the parent drug, $dLys^{-1}\text{-}Sar^0,C^{24}GLP(7\text{-}36)$ was incubated in plasma at 37° C. for approximately 30 h. Samples were collected at different time point (1 h, 12 h, 30 h). To investigate the restored activity after cleavage of the dipeptide from GLP-1 through DKP formation, all the collected samples were analyzed using a bioassay. More particularly, the receptor binding activity of GLP prodrugs were determined in the GLP-receptor Luciferase assay described in Example 5.

TABLE 6

Bioassay data at different time point of
dLys$^{-1}$-Sar$^0$,C$^{24}$GLP(7-36) in plasma

|  | GLP-STD | GLP-pro-1 h | GLP-pro-10 h | GLP-pro-30 h |
|---|---|---|---|---|
| EC50% | 0.02039 | 0.13933 | 0.03948 | 0.0233 |
| EC$_{50\%}$/STD ratio | 1 | 14.63% | 51.75% | 87.51% |

The half life of the degradation of the parent drug, dLys$^-$$_1$-Sar$^o$,C$^{24}$GLP(7-36) in plasma was then calculated by using the formula $t_{1/2}$=0.693/k and determined to be about 10 h.

Example 7

In Vivo Effects of Glucagon Superfamily Peptide Prodrugs in Mice

Diet-induced obesity (DIO) mice are injected intraperitoneally with a single weekly dose of a glucagon superfamily peptide (SEQ ID NOs: 1-684, 1701-1776, 1801-1908). Mice are weighed daily (N=8) after the initial injection with the following: vehicle only or a glucagon superfamily peptide, at about 0.5 nmol/kg, 3 nmol/kg, 10 nmol/kg, 15 nmol/kg, or 70 nmol/kg, or a prodrug derivative of the glucagon superfamily peptide wherein a dipeptide is linked to the N-terminus of glucagon superfamily peptide via an amide bond wherein the dipeptide is Aib$^{-1}$ Pro$_0$, Aib$^{-1}$ dPro$^0$, Lys$^{-1}$ Sar$^0$, dAla$^{-1}$ Pro$^0$, Ac-Aib$^{-1}$ Pro$^0$, Lys$^{-1}$(X) Sar$^0$ (X representing a 1 K PEG chain linked to the Lys side chain), Lys$^{-1}$(Y) Sar$^0$ (Y representing a tert-butyl glycine linked to the Lys side chain), dLys$^{-1}$ Sar$^0$, dLys$^{-1}$Gly(N-Hexyl)$^0$, or dLys$^{-1}$ F(N-Me)$^0$ (administered at about 0.5 nmol/kg, 3 nmol/kg, 10 nmol/kg, 15 nmol/kg or 70 nmol/kg). A saline solution comprising 25% (v/v) glucose is injected at a dose of 1.5 g/kg of body weight at the 0 min time point. Blood glucose levels are measured at the –60, 0, 15, 30, 60, and 120 min time points. Body weight, food intake, blood glucose and body composition are measured on days 0 and 1.

Example 8

Weight Loss Induced in Mice Administered Glucagon Analogs

Figure 1:
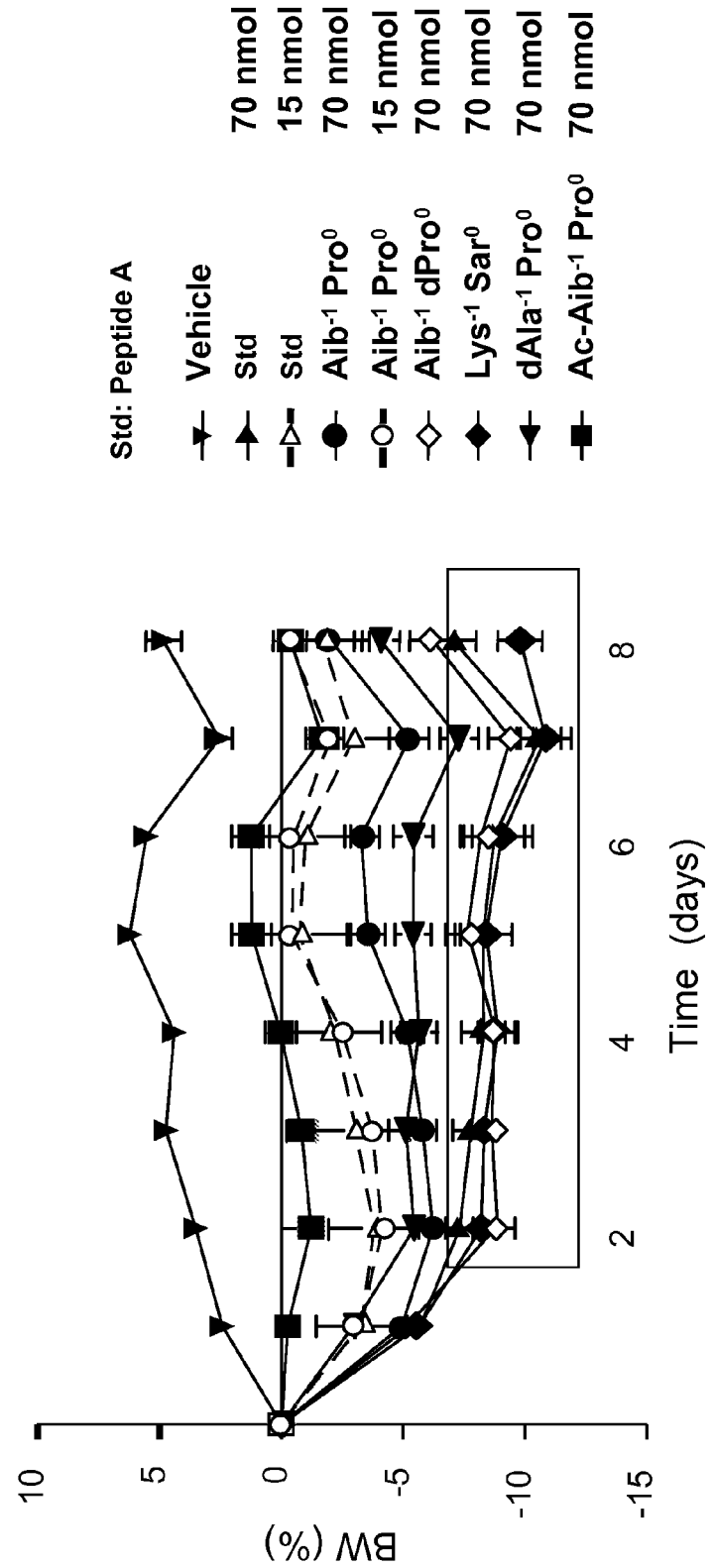
FIG. 1 is a graph showing the change in body weight in diet-induced obesity (DIO) mice injected intraperitoneally with a single weekly dose of 15 or 70 nmol/kg of a glucagon analog. Mice were weighed daily (N=8) after the initial injection with the following: vehicle only ▼, Glucagon Superfamily Peptide A ("Peptide A") at 15 nmol/kg (▷) or 70 nmol/kg (▶), or a prodrug derivative of Peptide A wherein a dipeptide is linked to the N-terminus of Peptide A via an amide bond wherein the dipeptide is Aib$^{-1}$ Pro$^0$ (administered at 15 nmol/kg (○) or 70 nmol/kg (●)), Aib$^{-1}$ dPro$^0$ (administered at 70 nmol/kg (◇)), Lys$^{-1}$ Sar$^0$ (administered at 70 nmol/kg (◆)), dAla$^{-1}$ Pro$^0$ (administered at 70 nmol/kg (◀)) or Ac-Aib$^{-1}$ Pro$^{-1}$ (administered at 70 nmol/kg (■)).

Diet-induced obesity (DIO) mice were injected intraperitoneally with a single weekly dose of 15 or 70 nmol/kg of a glucagon analog. Mice were weighed daily (N=8) after the initial injection with the following: vehicle only ▼, Glucanon Superfamily Peptide A ("Peptide A") at 15 nmol/kg (▷) or 70 nmol/kg (▶), or a prodrug derivative of Peptide A wherein a dipeptide is linked to the N-terminus of Peptide A via an amide bond wherein the dipeptide is Aib$^{-1}$ Pro$_0$ (adminstered at 15 nmol/kg (○) or 70 nmol/kg (●)), Aib$^{-1}$ dPro$^0$ (administered at 70 nmol/kg (◇)), Lys$^{-1}$ Sar$^0$ (adminstered at 70 nmol/kg (♦)), dAla$^{-1}$ Pro$^0$ (adminstered at 70 nmol/kg (◀)) or Ac-Aib$^{-1}$ Pro$^0$ (administered at 70 nmol/kg (■)). Results of the experiment are shown in FIG. 1. Note the compound Ac-Aib$^{-1}$ Pro$^0$ Peptide A is incapable of cleaving to form a diketopiperazine, yet the compound shows some level of activity beyond that seen for vehicle. This is presumably due to low residual activity of the prodrug. Peptide A is a pegylated analog of glucagon comprising 7 substitutions relative to native glucagon (SEQ ID NO: 701), a C-terminal amide, and pegylation with a maleimide-functionalized 40 k Da PEG.

Figure 2:
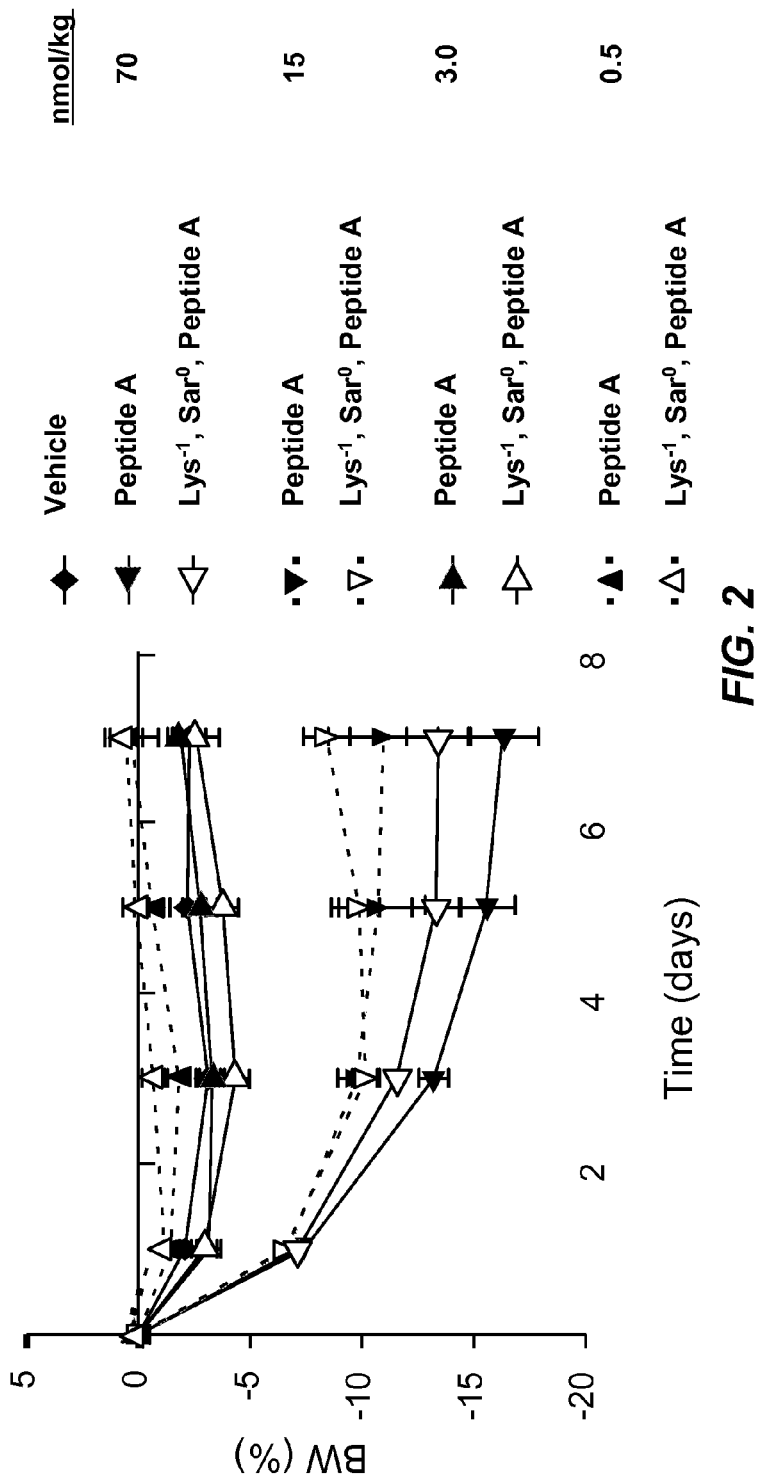
FIG. 2 is a graph showing the change in body weight in diet-induced obesity (DIO) mice injected intraperitoneally with a single weekly dose of 0.5, 3, 15 or 70 nmol/kg of either vehicle only (◆), Peptide A, (at 0.5 ▲, 3 ▶, 15 ▼ or 70 ◀ nmol/kg/day) or Lys$^{-1}$ Sar$^0$-Peptide A (at 0.5 △, 3 ▷, 15 ▽ or 70 ◁ nmol/kg/day).

FIG. 2 is a graph showing the change in body weight in diet-induced obesity (DIO) mice injected intraperitoneally with a single weekly dose of 0.5, 3, 15 or 70 nmol/kg of either vehicle only (♦), Peptide A, (at 0.5 ▲, 3 ▶, 15 ▼ or 70 ◀ nmol/kg/day) or Lys$^{-1}$ Sar$^0$ Peptide A, (at 0.5 △, 3 ▷, 15 ▽ or 70 ◁ nmol/kg/day). At all doses the two drugs appear to be producing a similar effect and thus the benefit from the addition of the dipeptide prodrug element appears to be minimal. This is likely due to enzymatic cleavage of the dipeptide and rapid activation of the administered prodrug.

Example 9

Glucose Tolerance Test Using Glucagon Prodrug Analogs

Diet-induced obesity (DIO) mice (N=8) were injected intraperitoneally with a 15 or 70 nmol/kg dose of one of the following:

(A) Peptide A, (at 15 ◁ or 70 ◀ nmol/kg/day), (B) Lys$^{-1}$ Sar$^0$ Peptide A, (at 15 ▷ or 70 ▶ nmol/kg/day), or (C) dLys$^{-1}$ Sar$^0$ Peptide A, (at 15 □, or 70 ■ nmol/kg/day).

Figure 3:
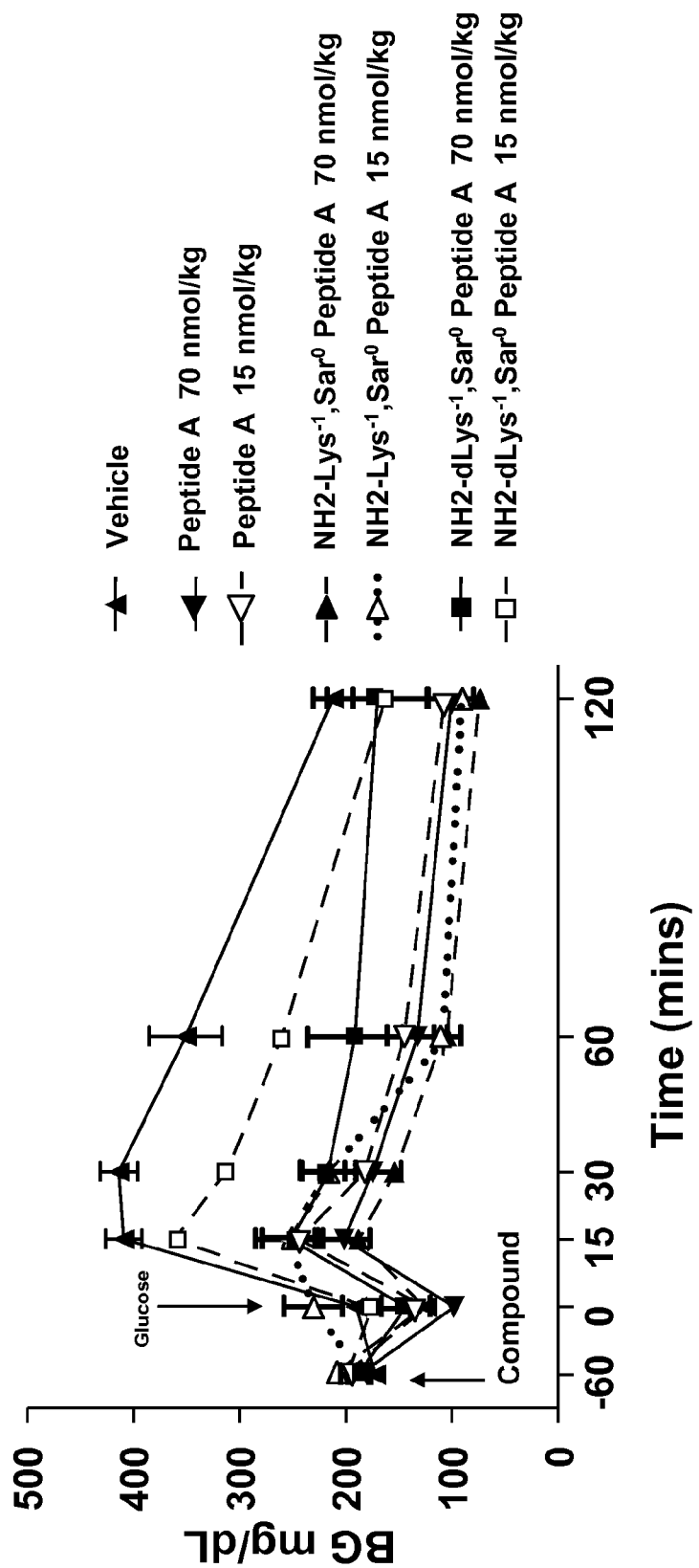
FIG. 3 is a graph of blood glucose levels (mg/dL) in DIO mice (N=8) injected first with a glucagon related peptide and then a glucose solution. Mice were injected intraperitoneally at the –60 min time point with vehicle only (▲), or a 15 or 70 nmol/kg dose of one of the following.

A saline solution comprising 25% (v/v) glucose was injected at a dose of 1.5 g/kg of body weight at the 0 min time point. Blood glucose levels were measured at the –60, 0, 15, 30, 60, and 120 min time points. FIG. 3 presents the data from this experiment.

FIG. 4 is a graph of blood glucose levels (mg/dL) in DIO mice (N=8) injected intraperitoneally at the –15 min time point with either vehicle only (▼) or 2 nmol/kg dose of one of the following compounds:

(A) Lys$^{-1}$ Sar$^0$ Peptide A (■), (B) Lys$^{-1}$(X), Sar$^0$ Peptide A (▲), (X representing a 1 K PEG chain linked to the Lys side chain)

(C) Lys$^{-1}$(Y), Sar$^0$ Peptide A (◇), (Y representing a tert-butyl glycine linked to the Lys side chain)

(D) dLys$^{-1}$ Sar$^0$ Peptide A, (▶).

A saline solution comprising 25% (v/v) glucose was injected at a dose of 1.5 g/kg of body weight at the 0 min time point. Blood glucose levels were measured at the –15, 0, 15, 30, 60, and 120 min time points.

FIG. 5 is a graph of blood glucose levels (mg/dL) in DIO mice (N=8) injected first with a glucagon related peptide and then a glucose solution. Mice were injected intraperitoneally at the –15 min time point with either vehicle (▼), a 20 nmol/kg dose for dLys$^{-1}$ Sar$^0$ Peptide A (▶), or a 0.67 nmol/kg dose of one of the following compounds:

(B) Lys$^{-1}$(X), Sar$^0$ Peptide A (▲), (X representing a 1 K PEG chain linked to the Lys side chain)

(C) Lys$^{-1}$(Y), Sar$^0$ Peptide A (◇), (Y representing a tert-butyl glycine linked to the Lys side chain).

The data from FIGS. 3-5 indicate that the Lys$^{-1}$, Sar$^0$ dipeptide fails to act like a prodrug element when linked to the N-terminus. However modifying the amino acids of the dipeptide, particularly the substitution of D-amino acid (dLys$^{-1}$) keeps the compound inactive (presumably by preventing enzymatic cleavage). The prodrug will then be activated based on the structure and stereochemistry of the dipeptide prodrug element and the strength of the nucleophile. As shown in FIG. 5, even at a much higher dose (20 nmol/kg dose vs 0.67 nmol/kg dose) the dLys$^{-1}$ Sar$^0$ Peptide A provides a prodrug effect.

Example 10

Diet-induced obesity (DIO) mice (N=8) were injected intraperitoneally with a 15 or 70 nmol/kg dose of one of the following compounds:

(A) Peptide A, (at 15 Δ or 70 ▲ nmol/kg/day), (B) dLys$^{-1}$ Sar$^0$ Peptide A, (at 15 □, or 70 ■ nmol/kg/day), or (C) Lys$^{-1}$ Sar$^0$ Peptide A, (at 15 ▷ or 70 ▶ nmol/kg/day).

at the −60 min time point. At 0 min and at 24 hr, 25% glucose in saline was injected intraperitoneally at a dose of 1.5 g per kg of body weight. Blood glucose levels were measured at the −60, 0, 15, 30, 60 and 120 time points. Body weight, food intake, blood glucose and body composition were measured on days 0 and 1, with N=8 DIO mice per group with an initial average body weight of 55 g. FIG. 6 is a graph of the blood glucose levels (mg/dL) in DIO mice (N=8) injected intraperitoneally at the −60 min time point with either vehicle only (▼) or 15 or 70 nmol/kg dose of the compounds described above.

A saline solution comprising 25% (v/v) glucose was injected at a dose of 1.5 g/kg of body weight at the 0 min time point and 24 hours later. Indicated blood glucose levels were measured at the −60, 0, 15, 30, 60, and 120 min time points relative to the first administration of the glucose solution (i.e., the 0 min time point).

FIG. 7 is a graph of blood glucose levels (mg/dL) in DIO mice (N=8) injected intraperitoneally at the −60 min time point with either vehicle only (▼) or 15 or 70 nmol/kg dose of one of the following compounds:

(A) Peptide A, (at 15 Δ or 70 ▲ nmol/kg/day), (B) dLys$^{-1}$ Sar$^0$ Peptide A, (at 15 ◇ or 70 ▽ nmol/kg/day), or (C) Lys$^{-1}$ Sar$^0$ Peptide A, (at 15 ◆, or 70 ■ nmol/kg/day).

A saline solution comprising 25% (v/v) glucose was injected at a dose of 1.5 g/kg of body weight at the 0 min time point and 24 hours later. Indicated blood glucose levels were measured at the 0, 15, 30, 60, and 120 min time points relative to the 24 hour administration of the second glucose solution.

FIG. 8 shows weight loss in DIO mice (N=8) injected intraperitoneally with the indicated compounds at either a 15 or 70 nmol/kg dose. The indicated body weights were determined 7 days after administration of the compounds.

Example 11

Diet-induced obesity (DIO) mice (N=8) were injected intraperitoneally with vehicle alone or a 15 nmol/kg dose of prodrug peptide 24, 8, 4 or 1 hour prior to glucose challenge with an injection of 25% glucose in saline at 1.5 g/kg of body weight. Indicated blood glucose levels were measured at the 0, 15, 30, 60, and 120 min time points relative to the challenge with glucose solution. Results of the study are illustrated in FIG. 9, and indicate that both Lys$^{-1}$ Sar$^0$ Peptide A (FIG. 9A) and dLys$^{-1}$ Sar$^0$ Peptide A (FIG. 9B) reduce blood glucose elevation relative to vehicle control. A comparison between the results from the two prodrugs indicates the difference between the effectiveness of initial blood glucose control relative the time period that the prodrug has been circulating. In mice administered the "d" stereoisomer initial control of blood glucose (i.e., early time point) was poor when the prodrug was administered one hour prior to challenge and better when administered well before challenge (e.g., the greatest initial control was when prodrug 8 and 24 hour time points). This study supports the conclusion that the prodrugs comprising the "d" stereoisomer remain in an inactive form for a longer time period than prodrugs comprising a "l" stereoisomer.

Example 12

Three prodrugs of Glucagon Superfamily Peptide B ("Peptide B") and Glucagon Superfamily Peptide C ("Peptide C") were synthesized according to the following procedures:

1) dK-Sar-Peptide C, wherein dK is the D isoform of Lys, Sar is sarcosine, and Peptide C is an analog of glucagon comprising 8 substitutions relative to native glucagon (SEQ ID NO: 701), a C-terminal amide, and pegylation with an iodoacetyl-functioned 40 k Da PEG.

The peptide sequence was assembled using solid-phase peptide synthesis. After the coupling and deprotection of the last residue His, the peptide bound resin was reacted with 5-fold excess Boc-sarcosine, DEPBT and DIEA in DMF, at room temperature for 6 h. The reaction was monitored by the nihydrin test. After completion of the coupling, the resin was washed 3 times with DMF and DCM, accordingly. The Boc protection was removed by TFA. The resin was washed by DCM, DMF and neutralized by DIEA. The resin-bound peptide was further reacted with 5-fold Boc-dLys, DEPBT and DIEA, at room temperature overnight. The resin was then treated by TFA to remove the Boc protection and washed by DCM, DMF. Finally, the resin was treated with 20% piperidine in DMF to remove to formyl group on $^{25}$Trp and dried under vacuum. The peptide was eventually cleaved by reaction with HF at 4° C. for 1 hour and precipitated by anhydrous ethyl ether. After filtration, the peptide was taken up by 20% acetonitrile (MeCN) in water and lyophilized to powder. The peptide was purified by preparative HPLC(C5 column; flow rate 10 ml/min; Buffer A 10% MeCN and 0.1% TFA in water; Buffer B: 0.1% TFA in ACN; A linear gradient B % from 0-40% (0-80 min)). The compound was verified by ESI-MS (3612.8 Daltons).

The resulting peptide was PEGylated by iodoacetyl-functioned 40 k Da PEG on the thiol group of 24-Cys. The peptide was dissolved in 4 M urea/50 nM Tris buffer (pH 6.6) at 4° C., overnight. The PEGylated peptide was purified by preparative HPLC and the identity confirmed by MALDI-TOF-MS (44000-46000, broad peak)

2) dK-Gly(N-Hexyl)-Peptide B, wherein dK is the D-isoform of Lys, Gly(N-Hexyl) is N-hexyl-Glycine, and Peptide B is an analog of glucagon comprising 8 substitutions relative to native glucagon (SEQ ID NO: 701), a C-terminal amide, and pegylation with a maleimide-functionalized 40 k Da PEG.

The peptide sequence was assembled using solid-phase peptide synthesis. The peptide bound resin was reacted with 5-fold excess bromoacetic acid, DIC and HOBT in DMF, at room temperature for 2 h. After a negative nihydrin test result was shown, the resin was washed 3 times with DMF and DCM, accordingly. Then the resin was reacted with 10-fold excess n-hexylamine and DIEA in DMF, at room temperature overnight. The resin-bound peptide was further reacted with 5-fold Boc-dLys, DEPBT and DIEA, at room temperature overnight. The resin was then washed 3-times with DMF and DCM. The resin-bound peptide was further reacted with 5-fold Boc-dLys, DEPBT and DIEA, at room temperature for 24 h. The resin was treated with TFA to remove the Boc protection and washed by DCM and DMF. Finally, the resin was treated with 20% piperidine in DMF to remove the formyl group on $^{25}$Trp and dried under vacuum. The peptide was eventually cleaved by reaction with HF at 4° C. for 1 hour, and precipitated using anhydrous ethyl ether. After filtration the peptide was redissolved using 20% MeCN in water and lyophilized to powder. The peptide was purified by preparative HPLC (C5 column; flow rate 10 ml/min; A buffer 10% MeCN and 0.1% TFA in water; B buffer 0.1% TFA in MeCN; A linear gradient B % from 0-40% (0-80 min)). The compound was verified by ESI-MS and had a mass of 3677.0 Daltons.

The resulting peptide was PEGylated with maleimide-functioned 40 k Da PEG on the thiol group of 24-Cys. The peptide was dissolved in 4 M urea/50 nM Tris buffer (pH 6.6) at 4° C., overnight. The PEGylated peptide was purified by preparative HPLC and the identity confirmed by MALDI-TOF-MS (44000-46000, broad peak).

3) dK-F(N-Me)-Peptide C, wherein dK is the D-isoform of Lys, F(N-Me) is N-methyl-Phe, and Peptide C is an analog of glucagon comprising 8 substitutions relative to native glucagon (SEQ ID NO: 701), a C-terminal amide, and pegylation with an iodoacetyl-functioned 40 kDa PEG. The peptide sequence was assembled using solid-phase peptide synthesis. The peptide bound resin was reacted with 5-fold excess of N-methyl phenyl alanine, DEPBT and DIEA in DMF, at room temperature for 6 h. After a negative nihydrin test result was shown, the resin was washed 3 times with DMF and DCM, accordingly. The resin was then treated with TFA to remove the Boc protection, washed with DCM and DMF, and neutralized by DIEA. The resin-bound peptide was further reacted with 5-fold Boc-dLys, DEPBT and DIEA, at room temperature overnight. The resin was then treated with TFA to remove the Boc protection and washed with DCM and DMF. Finally, the resin was treated with 20% piperidine in DMF to remove to formyl group on $^{25}$Trp and dried under vacuum. The peptide was eventually cleaved using HF at 4° C. for 1 hour and precipitated by anhydrous ethyl ether. After filtration the peptide was redissolved using 20% MeCN in water and lyophilized to powder. The peptide was purified by preparative HPLC. HPLC conditions: C5 column; flow rate 10 ml/min; A buffer 10% MeCN and 0.1% TFA in water; B buffer 0.1% TFA in MeCN; A linear gradient B % from 0-40% (0-80 min); PEG-insulin or analogues was collected at approximately 33% B. The desired compound was verified by ESI-MS and had a mass of 3701.0 Daltons.

The resulting peptide was PEGylated by iodoacetyl-functioned 40 k Da PEG on the thiol group of 24-Cys. The peptide was dissolved in 4 M urea/50 nM Tris buffer (pH 6.6) at 4° C., overnight. The PEGylated peptide was purified by preparative HPLC and the identity confirmed by MALDI-TOF-MS (44000-46000, broad peak).

Similar procedures are used to synthesize prodrugs comprising dLys-N-Methyl-Glycine, dLys-N-Hexyl-Glycine, and dLys-N-Methyl-Phenylalanine linked to any of SEQ ID NOs: 1-684, 701-731, 801-919, 1001-1262, 1301-1371, 1401-1518, 1701-1776, and 1801-1908.

Example 13

The three prodrugs described in Example 12 were tested for their in vivo effects in diet induced obesity (DIO) mice (strain: C57B16). Nine groups of eight mice (with an initial average body weight of 44.5 g) were subcutaneously injected with vehicle only or 10 nmol/kg of a prodrug peptide of Example 12 or the parent peptide (non-prodrug form lacking a dipeptide prodrug moiety). The mice were 5.5 months old and had been on a high fat diet for approximately 2 months. Blood glucose levels were taken at 0, 2, 4, 24, and 72 hours post injection (FIG. 11). Body weight was monitored for a week following injection and was measured on Day 0, 1, 3, 5, and 7, wherein Day 0 was the day of injection (FIG. 12). Food intake and fat mass were also monitored during the week long study.

The body weight of the mice receiving the parent peptide, the dK-Sar-containing prodrug, or the dK-Gly(N-Hexyl) prodrug steadily declined over the course of the study, as compared to the mice receiving a vehicle control. As expected, the parent peptide achieved the greatest decrease in body weight, suggesting that the prodrugs administered at higher doses may achieve the same effects as the parent peptide.

The change in blood glucose levels (Day 7-Day 0 levels) were greatest for the parent peptide, although the dK-Sar and dK-Gly(N-Hexyl) prodrugs also produced substantial decreases, as compared to vehicle control.

Example 14

The rate of DKP formation was modulated by the substitution of the side chain and/or alpha-amine of amino acid 'B' of the dipeptide prodrug A-B. Table 7 shows the rate of DKP formation using the dK-Sar and dK-Gly(N-Hexyl), dK-F(N-Me) prodrugs from Example 12.

TABLE 7

| Modulation of DKP Formation Rate dK-B-Glucagon Superfamily Peptide | | |
|---|---|---|
| Amino Acid "B" of the Dipeptide Prodrug | $t_{1/2}$ (h) | Glucagon Superfamily Peptide |
| Gly-N(Me) | 27 | Peptide C |
| Gly-N(Hexyl) | 14 | Peptide B |
| Phe-N(Me) | 60 | Peptide C |

Example 15

The receptor binding activity of the following peptides and prodrugs in 20% human plasma were determined over time using the GLP-receptor Luciferase assay described in Example 5:
 (A) GLP-1 (SEQ ID NO: 703),
 (B) Peptide C,
 (C) dLys$^{-1}$ Sar$^0$ Chimera Peptide C, or
 (D) dLys$^{-1}$ Gly(N-Hexyl)$^0$ Peptide B.

As shown in Table 8, the activities of the dLys$^{-1}$ Sar$^0$ and dLys$^{-1}$ Gly(N-Hexyl)$^0$ prodrugs gradually increased over time and matched native GLP-1 within 48 hours (FIGS. 13A and 13B).

TABLE 8

| Effect of Time on Conversion of Prodrug to Active Drug | | | | |
|---|---|---|---|---|
| | h* | 4 h | 8 h | 2 h |
| Peptide C | 00% | 7.3% | 7.3% | 1.0% |
| dLys$^{-1}$Sar$^0$ Peptide C | .7% | 04.5% | 87.5% | 46.4% |
| dLys$^{-1}$Gly(N-Hexyl)$^0$ Peptide B | 1.1% | 22.0% | 77.2% | 54.1% |

*5 hour incubation assay

Example 16

Lean, diet-induced obesity mice (N=14, strain: C57B16 WT)) were injected subcutaneously with a single weekly dose of 3, 10, or 30 nmol/kg of vehicle or one of the following compounds:

(A) Peptide C,
(B) dLys$^{-1}$ Sar$^0$ Peptide C, or
(C) dLys$^{-1}$ Gly(N-Hexyl)$^0$ Peptide B.

The mice had an average initial body weight of 31.2 g and were weighed on days 1, 3, 5, and 7. Blood glucose levels were taken intraperitoneally on days 1, 3, and 5. The mice were approximately 5 months old and were fed a regular chow diet for approximately 5 months.

Results of study are shown in FIGS. 14-15. FIG. 14 depicts a graph showing the change in body weight of the DIO mice on days 1, 3, 5, and 7. FIG. 15 depict graphs showing the blood glucose levels on day 1 (FIG. 15A), day 3 (FIG. 15B), and day 5 (FIG. 15C).

Example 17

The receptor binding activity of the following peptides and prodrugs in 20% human plasma were determined over time using the GLP-1 receptor assay described in Example 5:
(A) GLP-1
(B) Peptide C
(C) dLys$^{-1}$ Gly(N-Hexyl)$^0$ Peptide C
(D) dLys$^{-1}$ Sar$^0$ Peptide C
(E) dLys$^{-1}$ Phe(N-Methyl)$^0$ Peptide C As shown in Table 9, the activities of the dLys$^{-1}$ Gly(N-Hexyl)$^0$, dLys$^{-1}$ Sar$^0$, and dLys$^{-1}$ Phe(N-Methyl)$^0$ prodrugs gradually increased over time (FIGS. 16A-16C). The half-life of the prodrug can be tailored by altering the chemical structure of the second amino acid of the dipeptide prodrug element, also shown in Table 9.

TABLE 9

Effect of Time on EC$_{50}$ of the Prodrug and on the Conversion of Prodrug to Active Drug

| Incubation Time (h) | 0 | 18 | 42 | 90 | t$_{1/2}$ (h) |
|---|---|---|---|---|---|
| dLys$^{-1}$ Gly (N-Hexyl)$^0$ Peptide C | | | | | |
| EC$_{50}$ (nm) | 0.239 | 0.080 | 0.082 | 0.060 | 12 |
| Activity (%) | 28 | 83 | 82 | 112 | |
| dLys$^{-1}$ Sar$^0$ Peptide C | | | | | |
| EC$_{50}$ (nm) | 0.469 | 0.101 | 0.055 | 0.037 | 30 |
| Activity (%) | 7 | 32 | 59 | 87 | |
| dLys$^{-1}$ Phe (N-Methyl)$^0$ Peptide C | | | | | |
| EC$_{50}$ (nm) | 0.384 | 0.170 | 0.117 | 0.142 | 70 |
| Activity (%) | 15 | 33 | 48 | 39 | |

Example 18

The receptor binding activity of the following peptides and prodrugs in 20% human plasma were determined over time using the GLP-1 receptor assay described in Example 5:
(A) GLP-1
(B) Peptide D
(C) Aib$^{-1}$Sar$^0$ Peptide D
(D) dLys$^{-1}$ Sar$^0$ Peptide D
(E) dLys$^{-1}$ Gly(N-Hexyl)$^0$ Peptide D
(F) dLys$^{-1}$ Phe(N-Methyl)$^0$ Peptide D As shown in Table 10, the activities of the Aib$^{-1}$ Sar$^0$, dLys$^{-1}$ Sar$^0$, dLys$^{-1}$ Gly(N-Hexyl)$^0$, and dLys$^{-1}$ Phe(N-Methyl)$^0$ prodrugs gradually increased over time and were dependent on the structure of the dipeptide prodrug element (FIGS. 17A-17D). Peptide D, a class 2 glucagon related peptide, is an analog of glucagon comprising 3 substitutions relative to native glucagon (SEQ ID NO: 701), a C-terminal extension, C-terminal amide, acylation and pegylation.

TABLE 10

Effect of Time on Conversion of Prodrug to Active Drug

| | 5 h | 29 h | 54 h | 118 h | t$_{1/2}$ |
|---|---|---|---|---|---|
| Aib$^{-1}$Sar$^0$ Peptide D | 94% | 100% | 100% | 77.3% | 1-2 h |
| dLys$^{-1}$ Sar$^0$ Peptide D | 16.7% | 41.7% | 76.8% | 87.1% | 32-43 h |
| dLys$^{-1}$ Gly(N-Hexyl)$^0$ Peptide D | 6.1% | 95.1% | 100% | 100% | 6-8 h |
| dLys$^{-1}$ Phe(N-Methyl)$^0$ Peptide D | 4.7% | 9.4% | 19.3% | 28.4% | >100 h |

Example 19

Genetically bred diabetic/obese mice (N=8, strain: male db/db (BKS.Cg-Dock7m+/+Leprdb/J)) were injected subcutaneously with vehicle or a single dose of 10, 30 or 100 nmol/kg of one of the following compounds:
(A) Peptide D,
(B) Aib-Sar-Peptide D Blood glucose levels were taken intraperitoneally at hours 0, 4, 8, 24, 48, and 72. The mice were approximately 10-11 weeks of age (33.4-45.6 g) and were maintained on Certified Purina Rodent Chow #5001. The animals in each group had ad libitum access to food during the study.

Results of study are shown in FIG. 18. FIG. 18 depicts a graph showing the blood glucose levels over a 72 hour time course.

SEQUENCE LISTING (1921 sequences)

SEQ ID NO: 1 - protein, 29 aa, Homo sapiens
HSQGTFTSDYSKYLDSRRAQDFVQWLMNT

SEQ ID NO: 2 - protein, 29 aa, Artificial Sequence
  Synthetic Glucagon Analogue
  MOD_RES (16)..(16): Glu, Gln, homoglutamic acid or homocysteic acid
  MOD_RES (17)..(17): Arg, Cys, Orn, homocysteine or acetyl phenylalanine
  MOD_RES (27)..(27): Met, Leu or Nle
HSQGTFTSDYSKYLDXXRAQDFVQWLXNT

SEQ ID NO: 3 - protein, 29 aa, Artificial Sequence
  Synthetic Glucagon Analogue
  MOD_RES (16)..(16): Glu, Gln, homoglutamic acid or homocysteic acid
  MOD_RES (21)..(21): Asp, Cys, Orn, homocysteine or acetyl phenyalanine
  MOD_RES (27)..(27): Met, Leu or Nle
HSQGTFTSDYSKYLDXRRAQXFVQWLXNT

SEQ ID NO: 4 - protein, 29 aa, Artificial Sequence
  Synthetic Glucagon Analogue
  MOD_RES (16)..(16): Glu, Gln, homoglutamic acid or homocysteic acid
  MOD_RES (24)..(24): Gln, Cys, Orn, homocysteine or acetyl phenylalanine
  MOD_RES (27)..(27): Met, Leu or Nle
HSQGTFTSDYSKYLDXRRAQDFVXWLXNT

SEQ ID NO: 5 - protein, 29 aa, Artificial Sequence
  Synthetic Glucagon Analogue
  MOD_RES (16)..(16): Glu, Gln, homoglutamic acid or homocysteic acid
  MOD_RES (21)..(21): Asp, Cys, Orn, homocysteine or acetyl phenyalanine
  MOD_RES (24)..(24): Gln, Cys, Orn, homocysteine or acetyl phenyalanine
  MOD_RES (27)..(27): Met, Leu or Nle
HSQGTFTSDYSKYLDXRRAQXFVXWLXNT

SEQ ID NO: 6 - protein, 29 aa, Artificial Sequence
  Synthetic Glucagon Analogue
  MOD_RES (21)..(21): Asp, Cys, Orn, homocysteine or acetyl phenyalanine
  MOD_RES (27)..(27): Met, Leu or Nle
HSQGTFTSDYSKYLDERRAQXFVQWLXNT

SEQ ID NO: 7 - protein, 29 aa, Artificial Sequence
  Synthetic Glucagon Analogue
  MOD_RES (24)..(24): Gln, Cys, Orn, homocysteine or acetyl phenylalanine
  MOD_RES (27)..(27): Met, Leu or Nle
HSQGTFTSDYSKYLDERRAQDFVXWLXNT

SEQ ID NO: 8 - protein, 29 aa, Artificial Sequence
  Synthetic Glucagon Analogue
  MOD_RES (16)..(16): Glu, Gln, homoglutamic acid or homocysteic acid
HSQGTFTSDYSKYLDXRRAQDFVQWLMNT

SEQ ID NO: 9 - protein, 29 aa, Artificial Sequence
  Synthetic Glucagon Analogue
  MOD_RES (27)..(27): Met, Leu or Nle
HSQGTFTSDYSKYLDERRAQDFVQWLXNT

SEQ ID NO: 10 - protein, 29 aa, Artificial Sequence
  Synthetic Glucagon Analogue
HSQGTFTSDYSKYLDERRAQDFVQWLMNT

SEQ ID NO: 11 - protein, 29 aa, Artificial Sequence
  Synthetic Glucagon Analogue
  MISC_FEATURE: c-term amidation
HSQGTFTSDYSKYLDERRAQDFVQWLMNT

SEQ ID NO: 12 - protein, 29 aa, Artificial Sequence
  Synthetic Glucagon Analogue
  MISC_FEATURE (12)..(16): Lactam ring between side chains at position 12 and 16
HSQGTFTSDYSKYLDERRAQDFVQWLMNT

SEQ ID NO: 13 - protein, 29 aa, Artificial Sequence
  Synthetic Glucagon Analogue
  MISC_FEATURE (16)..(20): Lactam ring between side chains at positions 16 and 20
HSQGTFTSDYSKYLDERRAKDFVQWLMNT

SEQ ID NO: 14 - protein, 29 aa, Artificial Sequence
  Synthetic Glucagon Analogue
  MISC_FEATURE (22)..(24): Lactam ring between side chains at positions 22 and 24
HSQGTFTSDYSKYLDSRRAKDFVEWLMNT

SEQ ID NO: 15 - protein, 29 aa, Artificial Sequence
  Synthetic Glucagon Analogue
  MISC_FEATURE (24)..(28): Lactam ring formed between side chains at positions 24 and 28
HSQGTFTSDYSKYLDSRRAQDFVEWLMKT

SEQ ID NO: 16 - protein, 29 aa, Artificial Sequence
  Synthetic Glucagon Analogue
  MISC_FEATURE (12)..(16): Lactam ring between side chains at positions 12 and 16
  MISC_FEATURE (20)..(24): Lactam ring between side chains at positions 20 and 24
HSQGTFTSDYSKYLDERRAKDFVEWLMNT

SEQ ID NO: 17 - protein, 29 aa, Artificial Sequence
  Synthetic Glucagon Analogue
  MISC_FEATURE (16)..(20): Lactam ring between side chains at positions 16 and 20
  MISC_FEATURE (24)..(28): Lactam ring between side chains at positions 24 and 28
HSQGTFTSDYSKYLDERRADDFVEWLMKT

SEQ ID NO: 18 - protein, 29 aa, Artificial Sequence
  Synthetic Glucagon Analogue
  MISC_FEATURE (16)..(20): Lactam ring between side chains at positions 16 and 20
HSQGTFTSDYSKYLDERRAKDFVEWLMKT

SEQ ID NO: 19 - protein, 30 aa, Artificial Sequence
  Synthetic Glucagon Analogue
  MISC_FEATURE: c-term amidation
  MOD_RES (30)..(30): Variable amino acid
HSQGTFTSDYSKYLDERRAQDFVQWLMNTX

SEQ ID NO: 20 - protein, 29 aa, Artificial Sequence
  Synthetic Glucagon Analogue
  MOD_RES (16)..(16): Ser, Glu, Gln, homoglutamic acid or homocysteic acid
  MOD_RES (20)..(20): Gln, Lys, Arg, Orn or Citrulline
  MOD_RES (24)..(24): Gln or Glu
  MOD_RES (28)..(28): Asn, Asp or Lys
  MOD_RES (29)..(29): Thr or Gly
HSQGTFTSDYSKYLDXRRAXDFVXWLMXX

SEQ ID NO: 21 - protein, 29 aa, Artificial Sequence
  Synthetic Glucagon Analogue
  MISC_FEATURE: c-term amidation
  MOD_RES (2)..(2): D-Ser, Ala, Gly, N-methyl Ser or aminoisobutyric acid
HXQGTFTSDYSKYLDERRAQDFVQWLMNT

SEQ ID NO: 22 - protein, 29 aa, Artificial Sequence
  Synthetic Glucagon Analogue
  MISC_FEATURE: c-term amidation
  MOD_RES (2)..(2): Aminoisobutyric acid
HXQGTFTSDYSKYLDERRAQDFVQWLMNT

SEQ ID NO: 23 - protein, 29 aa, Artificial Sequence
  Synthetic Glucagon Analogue
  MISC_FEATURE: c-term amidation
  MOD_RES (17)..(17): Cys-PEG
  MOD_RES (27)..(27): Met, Leu or Nle
HSQGTFTSDYSKYLDECRAQDFVQWLXNT

SEQ ID NO: 24 - protein, 29 aa, Artificial Sequence
  Synthetic Glucagon Analogue
  MISC_FEATURE: c-term amidation
  MOD_RES (21)..(21): Cys-PEG
  MOD_RES (27)..(27): Met, Leu or Nle
HSQGTFTSDYSKYLDERRAQCFVQWLXNT

SEQ ID NO: 25 - protein, 29 aa, Artificial Sequence
  Synthetic Glucagon Analogue
  MISC_FEATURE: c-term amidation
  MOD_RES (24)..(24): Cys-PEG
  MOD_RES (27)..(27): Met, Leu or Nle
HSQGTFTSDYSKYLDERRAQDFVCWLXNT

SEQ ID NO: 26 - protein, 10 aa, Artificial Sequence
  Synthetic peptide fragment representing the carboxy terminal 10 amino acids Exendin-4
GPSSGAPPPS

SEQ ID NO: 27 - protein, 8 aa, Artificial Sequence
  Synthetic peptide fragment representing the carboxy terminal 8 amino acids of oxyntomodulin
KRNRNNIA

SEQ ID NO: 28 - protein, 4 aa, Artificial Sequence
  Synthetic peptide
KRNR

SEQ ID NO: 29 - protein, 10 aa, Artificial Sequence
  Synthetic peptide fragment representing the carboxy terminal 10 amino acids of Exendin-4
  MISC_FEATURE: c-term amidation
GPSSGAPPPS

SEQ ID NO: 30 - protein, 39 aa, Artificial Sequence
  Synthetic Glucagon Analogue
  MOD_RES (27)..(27): Met, Leu or Nle
HSQGTFTSDYSKYLDERRAQDFVQWLXNTGPSSGAPPPS

SEQ ID NO: 31 - protein, 37 aa, Artificial Sequence
  Synthetic Glucagon Analogue
  MOD_RES (27)..(27): Met, Leu or Nle
HSQGTFTSDYSKYLDERRAQDFVQWLXNTKRNRNNIA

SEQ ID NO: 32 - protein, 33 aa, Artificial Sequence
  Synthetic Glucagon Analogue
  MOD_RES (27)..(27): Met, Leu or Nle
HSQGTFTSDYSKYLDERRAQDFVQWLXNTKRNR

SEQ ID NO: 33 - protein, 29 aa, Artificial Sequence
  Synthetic Glucagon Analogue
  MOD_RES (15)..(15): Asp, Glu, homoglutamic acid, cysteic acid or homocysteic acid
  MOD_RES (16)..(16): Ser, Glu, Gln, homoglutamic acid or homocysteic acid
  MOD_RES (20)..(20): Gln or Lys
  MOD_RES (24)..(24): Gln or Glu
  MOD_RES (28)..(28): Asn, Lys or an acidic amino acid
  MOD_RES (29)..(29): Thr, Gly or an acidic amino acid
HSQGTFTSDYSKYLXXRRAXDFVXWLMXX

SEQ ID NO: 34 - protein, 29 aa, Artificial Sequence
  Synthetic Glucagon Analogue
  MOD_RES (15)..(15): Asp, Glu, cysteic acid, homoglutamic acid or homocysteic acid
  MOD_RES (16)..(16): Ser, Glu, Gln, homoglutamic acid or homocysteic acid
  MOD_RES (20)..(20): Gln or Lys
  MOD_RES (24)..(24): Gln or Glu
  MOD_RES (28)..(28): Asn, Asp or Lys
  MOD_RES (29)..(29): Thr or Gly
HSQGTFTSDYSKYLDXRRAXDFVXWLMXX

SEQ ID NO: 35 - protein, 29 aa, Artificial Sequence
  Synthetic Glucagon Analogue
HSQGTFTSDYSKYLDSCRAQDFVQWLMNT

SEQ ID NO: 36 - protein, 39 aa, Artificial Sequence
  Synthetic Glucagon Analogue
HSQGTFTSDYSKYLDSRRAQDFVQWLMNTGPSSGAPPPS

SEQ ID NO: 37 - protein, 29 aa, Artificial Sequence
  Synthetic Glucagon Analogue
  MOD_RES (24)..(24): 2-butyrolactone bound through thiol group of Cys
HSQGTFTSDYSKYLDSRRAQDFVCWLMNT

SEQ ID NO: 38 - protein, 29 aa, Artificial Sequence
  Synthetic Glucagon Analogue
  MOD_RES (24)..(24): Carboxymethyl group bound through thiol group of Cys
HSQGTFTSDYSKYLDSRRAQDFVCWLMNT

SEQ ID NO: 39 - protein, 39 aa, Artificial Sequence
  Synthetic Glucagon Analogue
HSQGTFTSDYSRYLDSRRAQDFVQWLMNTGPSSGAPPPS

SEQ ID NO: 40 - protein, 29 aa, Artificial Sequence
  Synthetic Glucagon Analogue
  MISC_FEATURE: c-term amidation
  MOD_RES (15)..(15): Glu or Asp
  MOD_RES (28)..(28): Glu or Asp
HSQGTFTSDYSKYLXERRAQDFVQWLMXT

SEQ ID NO: 41 - protein, 29 aa, Artificial Sequence
  Synthetic Glucagon Analogue
  MISC_FEATURE: c-term amidation; lactam ring between side chains at positions 12 and 16
  MISC_FEATURE: c-term amidation
  MISC_FEATURE (12)..(16): Lactam ring between side chains at positions 12 and 16
  MOD_RES (15)..(15): Glu or Asp
  MOD_RES (28)..(28): Glu or Asp
HSQGTFTSDYSKYLXERRAQDFVQWLMXT

SEQ ID NO: 42 - protein, 29 aa, Artificial Sequence
  Synthetic Glucagon Analogue
  MISC_FEATURE: c-term amidation; lactam ring between side chains at positions 16 and 20
  MISC_FEATURE: c-term amidation
  MOD_RES (15)..(15): Glu or Asp
  MISC_FEATURE (16)..(20): Lactam ring between side chains at positions 16 and 20
  MOD_RES (28)..(28): Glu or Asp
HSQGTFTSDYSKYLXERRAKDFVQWLMXT

SEQ ID NO: 43 - protein, 29 aa, Artificial Sequence
  Synthetic Glucagon Analogue
  MISC_FEATURE: c-term amidation
  MOD_RES (15)..(15): Glu or Asp
  MISC_FEATURE (20)..(24): Lactam ring between side chains at positions 20 and 24
  MOD_RES (28)..(28): Glu or Asp
HSQGTFTSDYSKYLXSRRAKDFVEWLMXT

SEQ ID NO: 44 - protein, 29 aa, Artificial Sequence
  Synthetic Glucagon Analogue
  MISC_FEATURE: c-term amidation
  MOD_RES (15)..(15): Glu or Asp
  MISC_FEATURE (24)..(28): Lactam ring between side chains at positions 24 and 28
  MOD_RES (29)..(29): Glu or Thr
HSQGTFTSDYSKYLXSRRAQDFVEWLMKX

SEQ ID NO: 45 - protein, 29 aa, Artificial Sequence
  Synthetic Glucagon Analogue
  MOD_RES (12)..(12): Lys or Glu
  MOD_RES (15)..(15): Asp, Glu, homoglutamic acid, cysteic acid or homocysteic acid
  MOD_RES (16)..(16): Ser, Gln, Glu, Lys, homoglutamic acid, cysteic acid or homocysteic acid
  MOD_RES (20)..(20): Gln, Glu or Lys
  MOD_RES (24)..(24): Gln, Lys or Glu
  MOD_RES (28)..(28): Asn, Lys or an acidic amino acid
  MOD_RES (29)..(29): Thr, Gly or an acidic amino acid
HSQGTFTSDYSXYLXXRRAXDFVXWLMXX

SEQ ID NO: 46 - protein, 29 aa, Artificial Sequence
  Synthetic Glucagon Analogue
  MOD_RES (16)..(16): Ser, Glu, Gln, homoglutamic acid or homocysteic acid
  MOD_RES (20)..(20): Gln or Lys
  MOD_RES (24)..(24): Gln or Glu
HSQGTFTSDYSKYLDXRRAXDFVXWLMNT

SEQ ID NO: 47 - protein, 29 aa, Artificial Sequence
  Synthetic Glucagon Analogue
HSQGTFTSDYSKYLDERRAKDFVQWLMNT

SEQ ID NO: 48 - protein, 29 aa, Artificial Sequence
  Synthetic Glucagon Analogue
HSQGTFTSDYSKYLDSRRAKDFVEWLMNT

SEQ ID NO: 49 - protein, 29 aa, Artificial Sequence
  Synthetic Glucagon Analogue
HSQGTFTSDYSKYLDSRRAQDFVEWLMKT

SEQ ID NO: 50 - protein, 31 aa, Homo sapiens
HAEGTFTSDVSSYLEGQAAKEFIAWLVKGRG

SEQ ID NO: 51 - protein, 29 aa, Artificial Sequence
  Synthetic Glucagon Analogue
  MOD_RES (15)..(15): Asp, Glu, homoglutamic acid, cysteic acid or homocysteic acid
  MOD_RES (16)..(16): Ser, Glu, Gln, homoglutamic acid or homocysteic acid
  MOD_RES (20)..(20): Gln, Lys, Arg, Orn, or Citrulline
  MOD_RES (21)..(21): Asp, Glu, homoglutamic acid, or homocysteic acid
  MOD_RES (24)..(24): Gln or Glu
  MOD_RES (28)..(28): Asn, Lys or an acidic amino acid
  MOD_RES (29)..(29): Thr, Gly or an acidic amino acid
HSQGTFTSDYSKYLXXRRAXXFVXWLMXX

SEQ ID NO: 52 - protein, 30 aa, Artificial Sequence
  Synthetic peptide
  MISC_FEATURE: c-term amidation
HAEGTFTSDVSSYLEGQAAKEFIAWLVKGR

SEQ ID NO: 53 - protein, 29 aa, Artificial Sequence
  Synthetic Glucagon Analogue
  MOD_RES (3)..(3): Glu, Orn or Nle
  MOD_RES (15)..(15): Asp, Glu, homoglutamic acid, cysteic acid or homocysteic acid
  MOD_RES (16)..(16): Ser, Glu, Gln, homoglutamic acid or homocysteic acid
  MOD_RES (20)..(20): Gln or Lys
  MOD_RES (24)..(24): Gln or Glu
  MOD_RES (28)..(28): Asn, Lys or an acidic amino acid
  MOD_RES (29)..(29): Thr or an acidic amino acid
HSXGTFTSDYSKYLXXRRAXDFVXWLMXX

SEQ ID NO: 54 - protein, 29 aa, Artificial Sequence
  Synthetic Glucagon Analogue
  MOD_RES (17)..(17): Arg or Gln
  MOD_RES (18)..(18): Arg or Ala
  MOD_RES (21)..(21): Asp or Glu
  MOD_RES (23)..(23): Val or Ile
  MOD_RES (24)..(24): Gln or Ala
HSQGTFTSDYSKYLDEXXAKXFXXWLMNT

SEQ ID NO: 55 - protein, 29 aa, Artificial Sequence
  Synthetic Glucagon Analogue
  MOD_RES (1)..(1): His, D-His, (Des-amino)His, hydroxyl-His, acetyl-His, homo-His or alpha, alpha-dimethyl imidiazole acetic acid (DMIA), N-methyl His, alpha-methyl His, or imidazole acetic acid
  MOD_RES (2)..(2): Ser, D-Ser, Ala, D-Ala, Val, Gly, N-methyl Ser, aminoisobutyric acid (AIB) or N-methyl Ala
  MOD_RES (3)..(3): Gln, Glu, Orn or  Nle
  MOD_RES (10)..(10): Tyr or Trp
  MOD_RES (12)..(12): Lys, Citrulline, Orn or Arg
  MOD_RES (15)..(15): Asp, Glu, cysteic acid, homoglutamic acid and homocysteic acid
  MOD_RES (16)..(16): Ser, Glu, Gln, homoglutamic acid or homocysteic acid
  MOD_RES (17)..(17): Arg, Gln, Lys, Cys, Orn, homocysteine or acetyl phenylalanine
  MOD_RES (18)..(18): Arg, Ala, Lys, Cys, Orn, homocysteine or acetyl phenyalanine
  MOD_RES (20)..(20): Gln, Lys, Arg, Orn or Citrulline
  MOD_RES (21)..(21): Gln, Glu, Asp, Lys, Cys, Orn, homocystein or acetyl phenyalanine
  MOD_RES (23)..(23): Val or Ile
  MOD_RES (24)..(24): Ala, Gln, Glu, Lys, Cys, Orn, homocysteine or acetyl phenyalanine
  MOD_RES (27)..(27): Met, Leu or Nle
  MOD_RES (28)..(28): Asn, Arg, Citrulline, Orn, Lys or Asp
  MOD_RES (29)..(29): Thr, Gly, Lys, Cys, Orn, homocycsteine or acetyl phenyalanine
XXXGTFTSDXSXYLXXXXAXXFXXWLXXX

SEQ ID NO: 56 - protein, 29 aa, Artificial Sequence
  Synthetic Glucagon Analogue
  MOD_RES (1)..(1): His, D-His, (Des-amino)His, hydroxyl-His, acetyl-His, homo-His, DMIA, N-methyl His, alpha-methyl His, or imidazole acetic acid
  MOD_RES (2)..(2): Ser, D-Ser, Ala, D-Ala, Val, Gly, N-methyl Ser, AIB or N-methyl Ala
  MOD_RES (3)..(3): Gln, Glu, Orn or  Nle
  MOD_RES (15)..(15): Asp, Glu, cysteic acid, homoglutamic acid and homocysteic acid
  MOD_RES (16)..(16): Ser, Glu, Gln, homoglutamic acid or homocysteic acid
  MOD_RES (20)..(20): Gln, Lys, Arg, Orn or Citrulline
  MOD_RES (21)..(21): Gln, Glu, Asp, Cys, Orn, homocycstein or acetyl phenyalanine
  MOD_RES (23)..(23): Val or Ile
  MOD_RES (24)..(24): Ala, Gln, Glu, Cys, Orn, homocycsteine or acetyl phenyalanine
  MOD_RES (27)..(27): Met, Leu or Nle
  MOD_RES (28)..(28): Asn, Lys or Asp
  MOD_RES (29)..(29): Thr, Gly, Lys, Cys, Orn, homocycsteine or acetyl phenyalanine
XXXGTFTSDYSKYLXXRRAXXFXXWLXXX

SEQ ID NO: 57 - protein, 29 aa, Artificial Sequence
  Synthetic Glucagon Analogue
  MOD_RES (1)..(1): His, D-His, (Des-amino)His, hydroxyl-His, acetyl- His, homo-His, DMIA, N-methyl His, alpha-methyl His, or imidazole acetic acid
  MOD_RES (2)..(2): Ser, D-Ser, Ala, D-Ala, Val, Gly, N-methyl Ser, AIB or N-methyl Ala
  MOD_RES (3)..(3): Gln, Glu, Orn or  Nle
  MISC_FEATURE (12)..(16): Lactam ring between side changes at position 12 and 16
  MOD_RES (15)..(15): Asp, Glu, cysteic acid, homoglutamic acid and homocysteic acid
  MOD_RES (20)..(20): Gln, Lys, Arg, Orn or Citrulline
  MOD_RES (21)..(21): Gln, Glu, Asp, Cys, Orn, homocycsteine or acetyl phenyalanine
  MOD_RES (23)..(23): Val or Ile
  MOD_RES (24)..(24): Ala, Gln, Glu, Lys, Cys, Orn, homocysteine or acetyl Phe
  MOD_RES (27)..(27): Met, Leu or Nle
  MOD_RES (28)..(28): Asn, Lys or Asp
  MOD_RES (29)..(29): Thr, Gly, Lys, Cys, Orn, homocysteine or acetyl phenyalanine
XXXGTFTSDYSKYLXERRAXXFXXWLXXX

SEQ ID NO: 58 - protein, 29 aa, Artificial Sequence
  Synthetic Glucagon Analogue
  MOD_RES (1)..(1): His, D-His, (Des-amino)His, hydroxyl-His, acetyl-His, homo-His, DMIA, N-methyl His, alpha-methyl His, or imidazole acetic acid
  MOD_RES (2)..(2): Ser, D-Ser, Ala, D-Ala, Val, Gly, N-methyl Ser, AIB or N-methyl Ala
  MOD_RES (3)..(3): Gln, Glu, Orn or Nle
  MOD_RES (15)..(15): Asp, Glu, cysteic acid, homoglutamic acid or homocysteic acid
  MISC_FEATURE (16)..(20): Lactam ring between side chains at positions 16 and 20
  MOD_RES (21)..(21): Gln, Glu, Asp, Lys, Cys, Orn, homocysteine or acetyl phenyalanine
  MOD_RES (23)..(23): Val or Ile
  MOD_RES (24)..(24): Ala, Gln, Glu, Lys, Cys, Orn, homocysteine or acetyl phenyalanine
  MOD_RES (27)..(27): Met, Leu or Nle
  MOD_RES (28)..(28): Asn, Lys or Asp
  MOD_RES (29)..(29): Thr, Gly, Lys, Cys, Orn, homocysteine or acetyl phenyalanine
XXXGTFTSDYSKYLXERRAKXFXXWLXXX

SEQ ID NO: 59 - protein, 29 aa, Artificial Sequence
  Synthetic Glucagon Analogue
  MOD_RES (1)..(1): His, D-His, (Des-amino)His, hydroxyl-His, acetyl-His, homo-His, DMIA, N-methyl His, alpha-methyl His, or imidazole acetic acid
  MOD_RES (2)..(2): Ser, D-Ser, Ala, D-Ala, Val, Gly, N-methyl Ser, AIB, or N-methyl Ala
  MOD_RES (3)..(3): Gln, Glu, Orn or  Nle
  MOD_RES (15)..(15): Asp, Glu, cysteic acid, homoglutamic acid and homocysteic acid
  MOD_RES (16)..(16): Ser, Glu, Gln, homoglutamic acid or homocysteic acid
  MISC_FEATURE (20)..(24): Lactam ring between side chains at position 20 and 24
  MOD_RES (21)..(21): Gln, Glu, Asp, Lys, Cys, Orn, homocysteine or acetyl phenyalanine
  MOD_RES (23)..(23): Val or Ile
  MOD_RES (27)..(27): Met, Leu or Nle
  MOD_RES (28)..(28): Asn, Lys or Asp
  MOD_RES (29)..(29): Thr, Gly, Lys, Cys, Orn, homocysteine or acetyl pheylalanine
XXXGTFTSDYSKYLXXRRAKXFXEWLXXX

SEQ ID NO: 60 - protein, 29 aa, Artificial Sequence
  Synthetic Glucagon Analogue
  MOD_RES (1)..(1): His, D-His, (Des-amino)His, hydroxyl-His, acetyl-His, homo-His, DMIA, N-methyl His, alpha-methyl His, or imidazole acetic acid
  MOD_RES (2)..(2): Ser, D-Ser, Ala, D-Ala, Val, Gly, N-methyl Ser, AIB or N-methyl Ala
  MOD_RES (3)..(3): Gln, Glu, Orn or  Nle
  MOD_RES (15)..(15): Asp, Glu, cysteic acid, homoglutamic acid and homocysteic acid
  MOD_RES (16)..(16): Ser, Glu, Gln, homoglutamic acid or homocysteic acid
  MOD_RES (20)..(20): Gln, Lys, Arg, Orn, or Citrulline
  MOD_RES (21)..(21): Gln, Glu, Asp, Lys, Cys, Orn, homocysteine or acetyl phenyalanine
  MOD_RES (23)..(23): Val or Ile
  MISC_FEATURE (24)..(28): Lactam ring between side chains at position 24 and 28
  MOD_RES (27)..(27): Met, Leu or Nle
  MOD_RES (29)..(29): Thr, Gly, Lys, Cys, Orn, homocysteine or acetyl phenyalanine
XXXGTFTSDYSKYLXXRRAXXFXEWLXKX

SEQ ID NO: 61 - protein, 40 aa, Artificial Sequence
  Synthetic Glucagon Analogue
  MISC_FEATURE: positions 30 to 40 are present only if position 29 is Gly; see specification as filed for detailed description of substitutions and preferred embodiments
  MOD_RES (1)..(1): His, D-His, (Des-amino)His, hydroxyl-His, acetyl-His, homo-His, DMIA, N-methyl His, alpha-methyl His, or imidazole acetic acid
  MOD_RES (2)..(2): Ser, D-Ser, Ala, Val, Gly, N-methyl Ser, Aib, N-methyl, Ala or D-Ala
  MOD_RES (18)..(18): Ala or Arg
  MOD_RES (24)..(24): Ala, Gln or Cys-PEG
  MOD_RES (29)..(29): Thr-CONH2, Cys-PEG, or Gly
  MOD_RES (40)..(40): Cys-PEG or not present
XXQGTFTSDYSKYLDERXAKDFVXWLMNXGPSSGAPPPSC

SEQ ID NO: 62 - protein, 40 aa, Artificial Sequence
  Synthetic Glucagon Analogue
  MISC_FEATURE: positions 30 to 40 are present only if position 29 is Gly; see specification as filed for detailed description of substitutions and preferred embodiments
  MOD_RES (1)..(1): His, D-His, (Des-amino)His, hydroxyl-His, acetyl-His, homo-His, DMIA, N-methyl His, alpha-methyl His, or imidazole acetic acid
  MOD_RES (2)..(2): Ser, D-Ser, Ala, Val, Gly, N-methyl Ser, AIB0, N-methyl Ala, or D-Ala
  MOD_RES (18)..(18): Ala or Arg
  MOD_RES (24)..(24): Ala, Gln or Cys-PEG
  MOD_RES (29)..(29): Thr-CONH2, Cys-PEG, or Gly
  MOD_RES (40)..(40): Cys-PEG or not present
XXQGTFTSDYSKYLDEQXAKEFIXWLMNXGPSSGAPPPSC

SEQ ID NO: 63 - protein, 29 aa, Artificial Sequence
  Synthetic Glucagon Analogue
  MOD_RES (16)..(16): Ser, Glu, Gln, homoglutamic acid or homocysteic acid
  MOD_RES (20)..(20): Gln or Lys
  MOD_RES (21)..(21): Asp, Lys, Cys, Orn, homocysteine or acetyl phealanine
  MOD_RES (24)..(24): Gln, Lys, Cys, Orn, homocysteine or acetyl phealanine
  MOD_RES (27)..(27): Met, Leu or Nle
HSQGTFTSDYSKYLDXRRAXXFVXWLXNT

SEQ ID NO: 64 - protein, 38 aa, Artificial Sequence
  Synthetic Glucagon Analogue
  MOD_RES (15)..(15): Asp, Glu, homoglutamic acid, cysteic acid or homocysteic acid
  MOD_RES (16)..(16): Ser, Glu, Gln, homoglutamic acid or homocysteic acid
  MOD_RES (20)..(20): Gln or Lys
  MOD_RES (24)..(24): Gln or Glu
  MOD_RES (28)..(28): Asn, Lys or Asp
HSQGTFTSDYSKYLXXRRAXDFVXWLMXGGPSSGPPPS

SEQ ID NO: 65 - protein, 11 aa, Artificial Sequence
  Synthetic peptide fragment representing the carboxy terminal 10 amino acids of Exdendin-4
  MOD_RES (11)..(11): Cys-PEG
GPSSGAPPPSC

SEQ ID NO: 66 - protein, 29 aa, Artificial Sequence
  Synthetic Glucagon Analogue
  MISC_FEATURE (12)..(16): Lactam ring between side chains at positions 12 and 16
  MOD_RES (28)..(28): Asp or Asn
  MOD_RES (29)..(29): Thr or Gly
HSQGTFTSDYSKYLDERRAQDFVQWLMXX

SEQ ID NO: 67 - protein, 29 aa, Artificial Sequence
  Synthetic Glucagon Analogue
  MISC_FEATURE (16)..(20): Lactam ring between side chains at positions 16 and 20
  MOD_RES (28)..(28): Asp or Asn
  MOD_RES (29)..(29): Thr or Gly
HSQGTFTSDYSKYLDERRAKDFVQWLMXX

SEQ ID NO: 68 - protein, 29 aa, Artificial Sequence
  Synthetic Glucagon Analogue
  MISC_FEATURE (20)..(24): Lactam ring between side chains at positions 20 and 24
  MOD_RES (28)..(28): Asp or Asn
  MOD_RES (29)..(29): Thr or Gly
HSQGTFTSDYSKYLDSRRAKDFVEWLMXX

SEQ ID NO: 69 - protein, 29 aa, Artificial Sequence
  glucagon analogue
  MISC_FEATURE (24)..(28): Lactam ring between side chains at positions 24 and 28
  MOD_RES (29)..(29): Thr or Gly
HSQGTFTSDYSKYLDSRRAQDFVEWLMKX

SEQ ID NO: 70 - protein, 29 aa, Artificial Sequence
  Synthetic peptide
  MISC_FEATURE: c-term amidation
HSQGTFTSDYSKYLDERRAQDFVQWLMNT

SEQ ID NO: 71 - protein, 29 aa, Artificial Sequence
  Synthetic peptide
  MISC_FEATURE: c-term amidation
HSQGTFTSDYSKYLDERRAKDFVQWLMNT

SEQ ID NO: 72 - protein, 29 aa, Artificial Sequence
  Synthetic peptide
  MISC_FEATURE: c-term amidation
  MISC_FEATURE (16)..(20): Lactam ring between side chains at positions 16 and 20
HSQGTFTSDYSKYLDERRAKDFVQWLMNT

SEQ ID NO: 73 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDERRAQDFVQWLMNT

SEQ ID NO: 74 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDERRAKDFVQWLMNT

SEQ ID NO: 75 - protein, 29 aa, Artificial Sequence
  Synthetic peptide
  MISC_FEATURE: c-term amidation
  MISC_FEATURE (16)..(20): Lactam ring between side chains at positions 16 and 20
HSQGTFTSDYSKYLDKRRAEDFVQWLMNT

SEQ ID NO: 76 - protein, 29 aa, Artificial Sequence
  Synthetic peptide
  MISC_FEATURE: c-term amidation
HSQGTFTSDYSKYLDERAAKDFVQWLMNT

SEQ ID NO: 77 - protein, 29 aa, Artificial Sequence
  Synthetic Polypeptide
  MISC_FEATURE: c-term amidation
  MISC_FEATURE (16)..(20): Lactam ring between side chains at positions 16 and 20
HSQGTFTSDYSKYLDERAAKDFVQWLMNT

SEQ ID NO: 78 - protein, 29 aa, Artificial Sequence
  Synthetic Polypeptide
  MISC_FEATURE: c-term amidation
  MISC_FEATURE (12)..(16): Lactam ring between side chains at positions 12 and 16
HSQGTFTSDYSKYLDERAAQDFVQWLMNT

SEQ ID NO: 79 - protein, 29 aa, Artificial Sequence
  Synthetic Polypeptide
  MISC_FEATURE: c-term amidation
  MISC_FEATURE (12)..(16): Lactam ring between side chains at positions 12 and 16
HSQGTFTSDYSKYLDERAAKDFVQWLMNT

SEQ ID NO: 80 - protein, 29 aa, Artificial Sequence
  Synthetic Polypeptide
  MISC_FEATURE: c-term amidation
  MISC_FEATURE (16)..(20): Lactam ring between side chains at positions 16 and 20
HSQGTFTSDYSKYLDKRAAEDFVQWLMNT

SEQ ID NO: 81 - protein, 29 aa, Artificial Sequence
  Synthetic Polypeptide
  MISC_FEATURE: c-term amidation
HSQGTFTSDYSKYLDEQAAKEFIAWLMNT

SEQ ID NO: 82 - protein, 29 aa, Artificial Sequence
  Synthetic Polypeptide
  MISC_FEATURE: c-term amidation
  MISC_FEATURE (12)..(16): Lactam ring between side chains at positions 12 and 16
HSQGTFTSDYSKYLDEQAAKEFIAWLMNT

SEQ ID NO: 83 - protein, 29 aa, Artificial Sequence
  Synthetic Polypeptide
  MISC_FEATURE: c-term amidation
  MISC_FEATURE (16)..(20): Lactam ring between side chains at positions 16 and 20
HSQGTFTSDYSKYLDEQAAKEFIAWLMNT

SEQ ID NO: 84 - protein, 29 aa, Artificial Sequence
  Synthetic Polypeptide
  MISC_FEATURE: c-term amidation
HSQGTFTSDYSKYLDEQAAKEFIAWLVKG

SEQ ID NO: 85 - protein, 29 aa, Artificial Sequence
  Synthetic Polypeptide
  MISC_FEATURE: c-term amidation
  MISC_FEATURE (12)..(16): Lactam ring between side chains at positions 12 and 16
HSQGTFTSDYSKYLDEQAAKEFIAWLVKG

SEQ ID NO: 86 - protein, 29 aa, Artificial Sequence
  Synthetic Polypeptide
  MISC_FEATURE: c-term amidation
  MISC_FEATURE (16)..(20): Lactam ring between side chains at positions 16 and 20
HSQGTFTSDYSKYLDEQAAKEFIAWLVKG

SEQ ID NO: 87 - protein, 29 aa, Artificial Sequence
  Synthetic Polypeptide
  MISC_FEATURE: c-term amidation
  MOD_RES (1)..(1): (Des-amino)His
XSQGTFTSDYSKYLDERRAQDFVQWLMNT

SEQ ID NO: 88 - protein, 29 aa, Artificial Sequence
  Synthetic Polypeptide
  MISC_FEATURE: c-term amidation
  MOD_RES (1)..(1): (Des-amino)His
XSQGTFTSDYSKYLDERRAKDFVQWLMNT

SEQ ID NO: 89 - protein, 29 aa, Artificial Sequence
  Synthetic Polypeptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDERRAKDFVQWLMNT

SEQ ID NO: 90 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERRAQDFVQWLMNT

SEQ ID NO: 91 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERRAKDFVQWLMNT

SEQ ID NO: 92 - protein, 29 aa, Artificial Sequence
  Synthetic Polypeptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDKRRAEDFVQWLMNT

SEQ ID NO: 93 - protein, 29 aa, Artificial Sequence
  Synthetic Polypeptide
  MOD_RES (1)..(1): (Des-amino)His
  MISC_FEATURE (29)..(29): c-term amidation
XSQGTFTSDYSKYLDERAAKDFVQWLMNT

SEQ ID NO: 94 - protein, 29 aa, Artificial Sequence
  Synthetic Polypeptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDERAAKDFVQWLMNT

SEQ ID NO: 95 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERAAQDFVQWLMNT

SEQ ID NO: 96 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERAAKDFVQWLMNT

SEQ ID NO: 97 - protein, 29 aa, Artificial Sequence
  Synthetic Polypeptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDKRAAEDFVQWLMNT

SEQ ID NO: 98 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDEQAAKEFIAWLMNT

SEQ ID NO: 99 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDEQAAKEFIAWLMNT

SEQ ID NO: 100 - protein, 29 aa, Artificial Sequence
  Synthetic Polypeptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDEQAAKEFIAWLMNT

SEQ ID NO: 101 - protein, 29 aa, Artificial Sequence
  Synthetic Polypeptide
  MISC_FEATURE: c-term amidation
  MOD_RES (1)..(1): (Des-amino)His
XSQGTFTSDYSKYLDEQAAKEFIAWLVKG

SEQ ID NO: 102 - protein, 29 aa, Artificial Sequence
  Synthetic Polypeptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDEQAAKEFIAWLVKG

SEQ ID NO: 103 - protein, 29 aa, Artificial Sequence
  Synthetic Polypeptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDEQAAKEFIAWLVKG

SEQ ID NO: 104 - protein, 29 aa, Artificial Sequence
  Synthetic Polypeptide
  MOD_RES (2)..(2): Aminoisobutyric acid
  MISC_FEATURE (29)..(29): c-term amidation
HXQGTFTSDYSKYLDERRAQDFVQWLMNT

SEQ ID NO: 105 - protein, 29 aa, Artificial Sequence
  Synthetic Polypeptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDERRAKDFVQWLMNT

SEQ ID NO: 106 - protein, 29 aa, Artificial Sequence
  Synthetic Polypeptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDERRAKDFVQWLMNT

SEQ ID NO: 107 - protein, 29 aa, Artificial Sequence
  Synthetic Polypeptide
  MISC_FEATURE: c-term amidation
  MOD_RES (2)..(2): Aminoisobutyric acid
  MISC_FEATURE (12)..(16): Lactam ring between side chains at positions 12 and 16
HXQGTFTSDYSKYLDERRAQDFVQWLMNT

SEQ ID NO: 108 - protein, 29 aa, Artificial Sequence
  Synthetic Polypeptide
  MISC_FEATURE: c-term amidation
  MOD_RES (2)..(2): Aminoisebutyric acid
  MISC_FEATURE (12)..(16): Lactam ring between side chains at positions 12 and 16
HXQGTFTSDYSKYLDERRAKDFVQWLMNT

SEQ ID NO: 109 - protein, 29 aa, Artificial Sequence
  Synthetic Polypeptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDKRRAEDFVQWLMNT

SEQ ID NO: 110 - protein, 29 aa, Artificial Sequence
  Synthetic Polypeptide
  MISC_FEATURE: c-term amidation
  MOD_RES (2)..(2): Aminoisobutyric acid
HXQGTFTSDYSKYLDERAAKDFVQWLMNT

SEQ ID NO: 111 - protein, 29 aa, Artificial Sequence
  Synthetic Polypeptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDERAAKDFVQWLMNT

SEQ ID NO: 112 - protein, 29 aa, Artificial Sequence
  Synthetic Polypeptide
  MISC_FEATURE: c-term amidation
  MOD_RES (2)..(2): Aminoisobutryic acid
  MISC_FEATURE (12)..(16): Lactam ring between side chains at positions 12 and 16
HXQGTFTSDYSKYLDERAAQDFVQWLMNT

SEQ ID NO: 113 - protein, 29 aa, Artificial Sequence
  glucagon analog
  MISC_FEATURE: c-term amidation
  MOD_RES (2)..(2): Aminoisobutryic acid
  MISC_FEATURE (12)..(16): Lactam ring between side chains at positions 12 and 16
HXQGTFTSDYSKYLDERAAKDFVQWLMNT

SEQ ID NO: 114 - protein, 29 aa, Artificial Sequence
  glucagon analog
  MISC_FEATURE: c-term amidation
  MOD_RES (2)..(2): Aminoisobutryic acid
  MISC_FEATURE (16)..(20): Lactam ring between side chains at positions 16 and 20
HXQGTFTSDYSKYLDKRAAEDFVQWLMNT

SEQ ID NO: 115 - protein, 29 aa, Artificial Sequence
  glucagon analog
  MISC_FEATURE: c-term amidation
  MOD_RES (2)..(2): Aminoisobutyric acid
HXQGTFTSDYSKYLDEQAAKEFIAWLMNT

SEQ ID NO: 116 - protein, 29 aa, Artificial Sequence
  glucagon analog
  MISC_FEATURE: c-term amidation
  MOD_RES (2)..(2): Aminoisobutryic acid
  MISC_FEATURE (12)..(16): Lactam ring between side chains at positions 12 and 16
HXQGTFTSDYSKYLDEQAAKEFIAWLMNT

SEQ ID NO: 117 - protein, 29 aa, Artificial Sequence
  glucagon analog
  MISC_FEATURE: c-term amidation
  MOD_RES (2)..(2): Aminoisobutryic acid
  MISC_FEATURE (16)..(20): Lactam ring between side chains at positions 16 and 20
HXQGTFTSDYSKYLDEQAAKEFIAWLMNT

SEQ ID NO: 118 - protein, 29 aa, Artificial Sequence
  glucagon analog
  MISC_FEATURE: c-term amidation
  MOD_RES (2)..(2): Aminoisobutyric acid
HXQGTFTSDYSKYLDEQAAKEFIAWLVKG

SEQ ID NO: 119 - protein, 29 aa, Artificial Sequence
  glucagon analog
  MISC_FEATURE: c-term amidation
  MOD_RES (2)..(2): Aminoisobutyric acid
  MISC_FEATURE (12)..(16): Lactam ring between side chains at positions 12 and 16
HXQGTFTSDYSKYLDEQAAKEFIAWLVKG

SEQ ID NO: 120 - protein, 29 aa, Artificial Sequence
  glucagon analog
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDEQAAKEFIAWLVKG

SEQ ID NO: 121 - protein, 29 aa, Artificial Sequence
  glucagon analog
  MISC_FEATURE: c-term amidation
  MOD_RES (2)..(2): D-Ala
HXQGTFTSDYSKYLDERRAQDFVQWLMNT

SEQ ID NO: 122 - protein, 29 aa, Artificial Sequence
  glucagon analog
  MISC_FEATURE: c-term amidation
  MOD_RES (2)..(2): D-Ala
HXQGTFTSDYSKYLDERRAKDFVQWLMNT

SEQ ID NO: 123 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDERRAKDFVQWLMNT

SEQ ID NO: 124 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERRAQDFVQWLMNT

SEQ ID NO: 125 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERRAKDFVQWLMNT

SEQ ID NO: 126 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDKRRAEDFVQWLMNT

SEQ ID NO: 127 - protein, 29 aa, Artificial Sequence
  glucagon analog
  MISC_FEATURE: c-term amidation
  MOD_RES (2)..(2): D-Ala
HXQGTFTSDYSKYLDERAAKDFVQWLMNT

SEQ ID NO: 128 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDERAAKDFVQWLMNT

SEQ ID NO: 129 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERAAQDFVQWLMNT

SEQ ID NO: 130 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERAAKDFVQWLMNT

SEQ ID NO: 131 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDKRAAEDFVQWLMNT

SEQ ID NO: 132 - protein, 29 aa, Artificial Sequence
  glucagon analog
  MISC_FEATURE: c-term amidation
  MOD_RES (2)..(2): D-Ala
HXQGTFTSDYSKYLDEQAAKEFIAWLMNT

SEQ ID NO: 133 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDEQAAKEFIAWLMNT

SEQ ID NO: 134 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDEQAAKEFIAWLMNT

SEQ ID NO: 135 - protein, 29 aa, Artificial Sequence
  glucagon analog
  MISC_FEATURE: c-term amidation
  MOD_RES (2)..(2): D-Ala
HXQGTFTSDYSKYLDEQAAKEFIAWLVKG

SEQ ID NO: 136 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDEQAAKEFIAWLVKG

SEQ ID NO: 137 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDEQAAKEFIAWLVKG

SEQ ID NO: 138 - protein, 29 aa, Artificial Sequence
  glucagon analog
  MISC_FEATURE: c-term amidation
HSEGTFTSDYSKYLDERRAQDFVQWLMNT

SEQ ID NO: 139 - protein, 29 aa, Artificial Sequence
  glucagon analog
  MISC_FEATURE: c-term amidation
HSEGTFTSDYSKYLDERRAKDFVQWLMNT

SEQ ID NO: 140 - protein, 29 aa, Artificial Sequence
  glucagon analog
  MISC_FEATURE: c-term amidation
  MISC_FEATURE (16)..(20): Lactam ring between side chains at positions 16 and 20
HSEGTFTSDYSKYLDERRAKDFVQWLMNT

SEQ ID NO: 141 - protein, 29 aa, Artificial Sequence
  glucagon analog
  MISC_FEATURE: c-term amidation
  MISC_FEATURE (12)..(16): Lactam ring between side chains at positions 12 and 16
HSEGTFTSDYSKYLDERRAQDFVQWLMNT

SEQ ID NO: 142 - protein, 29 aa, Artificial Sequence
  glucagon analog
  MISC_FEATURE: c-term amidation
  MISC_FEATURE (12)..(16): Lactam ring between side chains at positions 12 and 16
HSEGTFTSDYSKYLDERRAKDFVQWLMNT

SEQ ID NO: 143 - protein, 29 aa, Artificial Sequence
  glucagon analog
  MISC_FEATURE: c-term amidation
  MISC_FEATURE (16)..(20): Lactam ring between side chains at positions 16 and 20
HSEGTFTSDYSKYLDKRRAEDFVQWLMNT

SEQ ID NO: 144 - protein, 29 aa, Artificial Sequence
  glucagon analog
  MISC_FEATURE: c-term amidation
HSEGTFTSDYSKYLDERAAKDFVQWLMNT

SEQ ID NO: 145 - protein, 29 aa, Artificial Sequence
  glucagon analog
  MISC_FEATURE: c-term amidation
  MISC_FEATURE (16)..(20): Lactam ring between side chains at positions 16 and 20
HSEGTFTSDYSKYLDERAAKDFVQWLMNT

SEQ ID NO: 146 - protein, 29 aa, Artificial Sequence
  glucagon analog
  MISC_FEATURE: c-term amidation
  MISC_FEATURE (12)..(16): Lactam ring between side chains at positions 12 and 16
HSEGTFTSDYSKYLDERAAQDFVQWLMNT

SEQ ID NO: 147 - protein, 29 aa, Artificial Sequence
  glucagon analog
  MISC_FEATURE: c-term amidation
  MISC_FEATURE (12)..(16): Lactam ring between side chains at positions 12 and 16
HSEGTFTSDYSKYLDERAAKDFVQWLMNT

SEQ ID NO: 148 - protein, 29 aa, Artificial Sequence
  glucagon analog
  MISC_FEATURE: c-term amidation
  MISC_FEATURE (16)..(20): Lactam ring between side chains at positions 16 and 20
HSEGTFTSDYSKYLDKRAAEDFVQWLMNT

SEQ ID NO: 149 - protein, 29 aa, Artificial Sequence
  glucagon analog
  MISC_FEATURE: c-term amidation
HSEGTFTSDYSKYLDEQAAKEFIAWLMNT

SEQ ID NO: 150 - protein, 29 aa, Artificial Sequence
  glucagon analog
  MISC_FEATURE: c-term amidation
  MISC_FEATURE (12)..(16): Lactam ring between side chains at positions 12 and 16
HSEGTFTSDYSKYLDEQAAKEFIAWLMNT

SEQ ID NO: 151 - protein, 29 aa, Artificial Sequence
  glucagon analog
  MISC_FEATURE: c-term amidation
  MISC_FEATURE (16)..(20): Lactam ring between side chains at positions 16 and 20
HSEGTFTSDYSKYLDEQAAKEFIAWLMNT

SEQ ID NO: 152 - protein, 29 aa, Artificial Sequence
  glucagon analog
  MISC_FEATURE: c-term amidation
HSEGTFTSDYSKYLDEQAAKEFIAWLVKG

SEQ ID NO: 153 - protein, 29 aa, Artificial Sequence
  glucagon analog
  MISC_FEATURE: c-term amidation
  MISC_FEATURE (12)..(16): Lactam ring between side chains at positions 12 and 16
HSEGTFTSDYSKYLDEQAAKEFIAWLVKG

SEQ ID NO: 154 - protein, 29 aa, Artificial Sequence
  glucagon analog
  MISC_FEATURE: c-term amidation
  MISC_FEATURE (16)..(20): Lactam ring between side chains at positions 16 and 20
HSEGTFTSDYSKYLDEQAAKEFIAWLVKG

SEQ ID NO: 155 - protein, 29 aa, Artificial Sequence
  glucagon analog
  MISC_FEATURE: c-term amidation
  MOD_RES (1)..(1): (Des-amino)His
XSEGTFTSDYSKYLDERRAQDFVQWLMNT

SEQ ID NO: 156 - protein, 29 aa, Artificial Sequence
  glucagon analog
  MISC_FEATURE: c-term amidation
  MOD_RES (1)..(1): (Des-amino)His
XSEGTFTSDYSKYLDERRAKDFVQWLMNT

SEQ ID NO: 157 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDERRAKDFVQWLMNT

SEQ ID NO: 158 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDERRAQDFVQWLMNT

SEQ ID NO: 159 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDERRAKDFVQWLMNT

SEQ ID NO: 160 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDKRRAEDFVQWLMNT

SEQ ID NO: 161 - protein, 29 aa, Artificial Sequence
  glucagon analog
  MISC_FEATURE: c-term amidation
  MOD_RES (1)..(1): (Des-amino)His
XSEGTFTSDYSKYLDERAAKDFVQWLMNT

SEQ ID NO: 162 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDERAAKDFVQWLMNT

SEQ ID NO: 163 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDERAAQDFVQWLMNT

SEQ ID NO: 164 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDERAAKDFVQWLMNT

SEQ ID NO: 165 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDKRAAEDFVQWLMNT

SEQ ID NO: 166 - protein, 29 aa, Artificial Sequence
  glucagon analog
  MISC_FEATURE: c-term amidation
  MOD_RES (1)..(1): (Des-amino)His
XSEGTFTSDYSKYLDEQAAKEFIAWLMNT

SEQ ID NO: 167 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDEQAAKEFIAWLMNT

SEQ ID NO: 168 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDEQAAKEFIAWLMNT

SEQ ID NO: 169 - protein, 29 aa, Artificial Sequence
  glucagon analog
  MISC_FEATURE: c-term amidation
  MOD_RES (1)..(1): (Des-amino)His
XSEGTFTSDYSKYLDEQAAKEFIAWLVKG

SEQ ID NO: 170 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDEQAAKEFIAWLVKG

SEQ ID NO: 171 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDEQAAKEFIAWLVKG

SEQ ID NO: 172 - protein, 29 aa, Artificial Sequence
  glucagon analog
  MISC_FEATURE: c-term amidation
  MOD_RES (2)..(2): Aminoisobutyric acid
HXEGTFTSDYSKYLDERRAQDFVQWLMNT

SEQ ID NO: 173 - protein, 29 aa, Artificial Sequence
  glucagon analog
  MISC_FEATURE: c-term amidation
  MOD_RES (2)..(2): Aminoisobutyric acid
HXEGTFTSDYSKYLDERRAKDFVQWLMNT

SEQ ID NO: 174 - protein, 29 aa, Artificial Sequence
  glucagon analog
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDERRAKDFVQWLMNT

SEQ ID NO: 175 - protein, 29 aa, Artificial Sequence
  glucagon analog
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERRAQDFVQWLMNT

SEQ ID NO: 176 - protein, 29 aa, Artificial Sequence
  glucagon analog
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERRAKDFVQWLMNT

SEQ ID NO: 177 - protein, 29 aa, Artificial Sequence
  glucagon analog
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDKRRAEDFVQWLMNT

SEQ ID NO: 178 - protein, 29 aa, Artificial Sequence
  glucagon analog
  MISC_FEATURE: c-term amidation
  MOD_RES (2)..(2): Aminoisobutyric acid
HXEGTFTSDYSKYLDERAAKDFVQWLMNT

SEQ ID NO: 179 - protein, 29 aa, Artificial Sequence
  glucagon analog
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDERAAKDFVQWLMNT

SEQ ID NO: 180 - protein, 29 aa, Artificial Sequence
  glucagon analog
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERAAQDFVQWLMNT

SEQ ID NO: 181 - protein, 29 aa, Artificial Sequence
  glucagon analog
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERAAKDFVQWLMNT

SEQ ID NO: 182 - protein, 29 aa, Artificial Sequence
  glucagon analog
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDKRAAEDFVQWLMNT

SEQ ID NO: 183 - protein, 29 aa, Artificial Sequence
  glucagon analog
  MISC_FEATURE: c-term amidation
  MOD_RES (2)..(2): Aminoisobutyric acid
HXEGTFTSDYSKYLDEQAAKEFIAWLMNT

SEQ ID NO: 184 - protein, 29 aa, Artificial Sequence
  glucagon analog
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDEQAAKEFIAWLMNT

SEQ ID NO: 185 - protein, 29 aa, Artificial Sequence
  glucagon analog
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDEQAAKEFIAWLMNT

SEQ ID NO: 186 - protein, 29 aa, Artificial Sequence
  glucagon analog
  MISC_FEATURE: c-term amidation
  MOD_RES (2)..(2): Aminoisobutyric acid
HXEGTFTSDYSKYLDEQAAKEFIAWLVKG

SEQ ID NO: 187 - protein, 29 aa, Artificial Sequence
  glucagon analog
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDEQAAKEFIAWLVKG

SEQ ID NO: 188 - protein, 29 aa, Artificial Sequence
  glucagon analog
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDEQAAKEFIAWLVKG

SEQ ID NO: 189 - protein, 29 aa, Artificial Sequence
  glucagon analog
  MISC_FEATURE: c-term amidation
  MOD_RES (2)..(2): D-Ala
HXEGTFTSDYSKYLDERRAQDFVQWLMNT

SEQ ID NO: 190 - protein, 29 aa, Artificial Sequence
  glucagon analog
  MISC_FEATURE: c-term amidation
  MOD_RES (2)..(2): D-Ala
HXEGTFTSDYSKYLDERRAKDFVQWLMNT

SEQ ID NO: 191 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDERRAKDFVQWLMNT

SEQ ID NO: 192 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERRAQDFVQWLMNT

SEQ ID NO: 193 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERRAKDFVQWLMNT

SEQ ID NO: 194 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDKRRAEDFVQWLMNT

SEQ ID NO: 195 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDERAAKDFVQWLMNT

SEQ ID NO: 196 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDERAAKDFVQWLMNT

SEQ ID NO: 197 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERAAQDFVQWLMNT

SEQ ID NO: 198 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERAAKDFVQWLMNT

SEQ ID NO: 199 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDKRAAEDFVQWLMNT

SEQ ID NO: 200 - protein, 29 aa, Artificial Sequence
  glucagon analog
  MISC_FEATURE: c-term amidation
  MOD_RES (2)..(2): D-Ala
HXEGTFTSDYSKYLDEQAAKEFIAWLMNT

SEQ ID NO: 201 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDEQAAKEFIAWLMNT

SEQ ID NO: 202 - protein, 29 aa, Artificial Sequence
  glucagon analog
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDEQAAKEFIAWLMNT

SEQ ID NO: 203 - protein, 29 aa, Artificial Sequence
  glucagon analog
  MISC_FEATURE: c-term amidation
  MOD_RES (2)..(2): D-Ala
HXEGTFTSDYSKYLDEQAAKEFIAWLVKG

SEQ ID NO: 204 - protein, 29 aa, Artificial Sequence
  glucagon analog
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDEQAAKEFIAWLVKG

SEQ ID NO: 205 - protein, 29 aa, Artificial Sequence
  glucagon analog
  MISC_FEATURE: Lactam ring between side chains at positions 16 and 20
  MOD_RES (2)..(2): D-Ala
  MISC_FEATURE (16)..(20): c-term amidation
HXEGTFTSDYSKYLDEQAAKEFIAWLVKG

SEQ ID NO: 206 - protein, 29 aa, Artificial Sequence
  glucagon analog
  MISC_FEATURE: c-term amidation
  MOD_RES (24)..(24): Cys-PEG
HSQGTFTSDYSKYLDERRAQDFVCWLMNT

SEQ ID NO: 207 - protein, 29 aa, Artificial Sequence
  glucagon analog
  MISC_FEATURE: c-term amidation
  MOD_RES (24)..(24): Cys-PEG
HSQGTFTSDYSKYLDERRAKDFVCWLMNT

SEQ ID NO: 208 - protein, 29 aa, Artificial Sequence
  glucagon analog
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDERRAKDFVCWLMNT

SEQ ID NO: 209 - protein, 29 aa, Artificial Sequence
  glucagon analog
  MISC_FEATURE: c-term amidation
  MISC_FEATURE (12)..(16): Lactam ring between side chains at positions 12 and 16
  MOD_RES (24)..(24): Cys-PEG
HSQGTFTSDYSKYLDERRAQDFVCWLMNT

SEQ ID NO: 210 - protein, 29 aa, Artificial Sequence
  glucagon analog
  MISC_FEATURE: c-term amidation
  MISC_FEATURE (12)..(16): Lactam ring between side chains at positions 12 and 16
  MOD_RES (24)..(24): Cys-PEG
HSQGTFTSDYSKYLDERRAKDFVCWLMNT

SEQ ID NO: 211 - protein, 29 aa, Artificial Sequence
  glucagon analog
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDKRRAEDFVCWLMNT

SEQ ID NO: 212 - protein, 29 aa, Artificial Sequence
  glucagon analog
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDERAAKDFVCWLMNT

SEQ ID NO: 213 - protein, 29 aa, Artificial Sequence
  glucagon analog
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDERAAKDFVCWLMNT

SEQ ID NO: 214 - protein, 29 aa, Artificial Sequence
  glucagon analog
  MISC_FEATURE: c-term amidation
  MISC_FEATURE (12)..(16): Lactam ring between side chains at positions 12 and 16
  MOD_RES (24)..(24): Cys-PEG
HSQGTFTSDYSKYLDERAAQDFVCWLMNT

SEQ ID NO: 215 - protein, 29 aa, Artificial Sequence
  glucagon analog
  MISC_FEATURE: c-term amidation
  MISC_FEATURE (12)..(16): Lactam ring between side chains at positions 12 and 16
  MOD_RES (24)..(24): Cys-PEG
HSQGTFTSDYSKYLDERAAKDFVCWLMNT

SEQ ID NO: 216 - protein, 29 aa, Artificial Sequence
  glucagon analog
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDKRAAEDFVCWLMNT

SEQ ID NO: 217 - protein, 29 aa, Artificial Sequence
  glucagon analog
  MISC_FEATURE: c-term amidation
  MOD_RES (24)..(24): Cys-PEG
HSQGTFTSDYSKYLDEQAAKEFICWLMNT

SEQ ID NO: 218 - protein, 29 aa, Artificial Sequence
  glucagon analog
  MISC_FEATURE: c-term amidation
  MISC_FEATURE (12)..(16): Lactam ring between side chains at positions 12 and 16
  MOD_RES (24)..(24): Cys-PEG
HSQGTFTSDYSKYLDEQAAKEFICWLMNT

SEQ ID NO: 219 - protein, 29 aa, Artificial Sequence
  glucagon analog
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDEQAAKEFICWLMNT

SEQ ID NO: 220 - protein, 29 aa, Artificial Sequence
  glucagon analog
  MISC_FEATURE: c-term amidation
  MOD_RES (24)..(24): Cys-PEG
HSQGTFTSDYSKYLDEQAAKEFICWLVKG

SEQ ID NO: 221 - protein, 29 aa, Artificial Sequence
  glucagon analog
  MISC_FEATURE: c-term amidation
  MISC_FEATURE (12)..(16): Lactam ring between side chains at positions 12 and 16
  MOD_RES (24)..(24): Cys-PEG
HSQGTFTSDYSKYLDEQAAKEFICWLVKG

SEQ ID NO: 222 - protein, 29 aa, Artificial Sequence
  glucagon analog
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDEQAAKEFICWLVKG

SEQ ID NO: 223 - protein, 29 aa, Artificial Sequence
  glucagon analog
  MISC_FEATURE: c-term amidation
  MOD_RES (1)..(1): (Des-amino)His
  MOD_RES (24)..(24): Cys-PEG
XSQGTFTSDYSKYLDERRAQDFVCWLMNT

SEQ ID NO: 224 - protein, 29 aa, Artificial Sequence
  glucagon analog
  MISC_FEATURE: c-term amidation
  MOD_RES (1)..(1): (Des-amino)His
  MOD_RES (24)..(24): Cys-PEG
XSQGTFTSDYSKYLDERRAKDFVCWLMNT

SEQ ID NO: 225 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSQGTFTSDYSKYLDERRAKDFVCWLMNT

SEQ ID NO: 226 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSQGTFTSDYSKYLDERRAQDFVCWLMNT

SEQ ID NO: 227 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSQGTFTSDYSKYLDERRAKDFVCWLMNT

SEQ ID NO: 228 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSQGTFTSDYSKYLDKRRAEDFVCWLMNT

SEQ ID NO: 229 - protein, 29 aa, Artificial Sequence
  glucagon analog
  MISC_FEATURE: c-term amidation
  MOD_RES (1)..(1): (Des-amino)His
  MOD_RES (24)..(24): Cys-PEG
XSQGTFTSDYSKYLDERAAKDFVCWLMNT

SEQ ID NO: 230 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSQGTFTSDYSKYLDERAAKDFVCWLMNT

SEQ ID NO: 231 - protein, 29 aa, Artificial Sequence
  glucagon analog
  MISC_FEATURE: c-term amidation; lactam ring between side chains at positions 12 and 16
  MOD_RES (1)..(1): (Des-amino)His
  MOD_RES (24)..(24): Cys-PEG
XSQGTFTSDYSKYLDERAAQDFVCWLMNT

SEQ ID NO: 232 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSQGTFTSDYSKYLDERAAKDFVCWLMNT

SEQ ID NO: 233 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSQGTFTSDYSKYLDKRAAEDFVCWLMNT

SEQ ID NO: 234 - protein, 29 aa, Artificial Sequence
  glucagon analog
  MISC_FEATURE: c-term amidation
  MOD_RES (1)..(1): (Des-amino)His
  MOD_RES (24)..(24): Cys-PEG
XSQGTFTSDYSKYLDEQAAKEFICWLMNT

SEQ ID NO: 235 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSQGTFTSDYSKYLDEQAAKEFICWLMNT

SEQ ID NO: 236 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSQGTFTSDYSKYLDEQAAKEFICWLMNT

SEQ ID NO: 237 - protein, 29 aa, Artificial Sequence
  glucagon analog
  MISC_FEATURE: c-term amidation
  MOD_RES (1)..(1): (Des-amino)His
  MOD_RES (24)..(24): Cys-PEG
XSQGTFTSDYSKYLDEQAAKEFICWLVKG

SEQ ID NO: 238 - protein, 29 aa, Artificial Sequence
  glucagon analog
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSQGTFTSDYSKYLDEQAAKEFICWLVKG

SEQ ID NO: 239 - protein, 29 aa, Artificial Sequence
  glucagon analog
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSQGTFTSDYSKYLDEQAAKEFICWLVKG

SEQ ID NO: 240 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERRAQDFVCWLMNT

SEQ ID NO: 241 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERRAKDFVCWLMNT

SEQ ID NO: 242 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDERRAKDFVCWLMNT

SEQ ID NO: 243 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXQGTFTSDYSKYLDERRAQDFVCWLMNT

SEQ ID NO: 244 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXQGTFTSDYSKYLDERRAKDFVCWLMNT

SEQ ID NO: 245 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring side chains at positions 16 and 20
  MOD_RES (24)..(24): Cys-PEG
HXQGTFTSDYSKYLDKRRAEDFVCWLMNT

SEQ ID NO: 246 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERAAKDFVCWLMNT

SEQ ID NO: 247 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDERAAKDFVCWLMNT

SEQ ID NO: 248 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXQGTFTSDYSKYLDERAAQDFVCWLMNT

SEQ ID NO: 249 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXQGTFTSDYSKYLDERAAKDFVCWLMNT

SEQ ID NO: 250 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXQGTFTSDYSKYLDKRAAEDFVCWLMNT

SEQ ID NO: 251 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDEQAAKEFICWLMNT

SEQ ID NO: 252 - protein, 29 aa, Artificial Sequence
  Synthetic peptide
  misc_feature (2)..(2): Xaa can be any naturally occurring amino acid
HXQGTFTSDYSKYLDEQAAKEFICWLMNT

SEQ ID NO: 253 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDEQAAKEFICWLMNT

SEQ ID NO: 254 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDEQAAKEFICWLVKG

SEQ ID NO: 255 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXQGTFTSDYSKYLDEQAAKEFICWLVKG

SEQ ID NO: 256 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDEQAAKEFICWLVKG

SEQ ID NO: 257 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXQGTFTSDYSKYLDERRAQDFVCWLMNT

SEQ ID NO: 258 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXQGTFTSDYSKYLDERRAKDFVCWLMNT

SEQ ID NO: 259 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXQGTFTSDYSKYLDERRAKDFVCWLMNT

SEQ ID NO: 260 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chrains at positions 12 and 16
  MOD_RES (24)..(24): Cys-PEG
HXQGTFTSDYSKYLDERRAQDFVCWLMNT

SEQ ID NO: 261 - protein, 29 aa, Artificial Sequence
  Synthetic peptide
  MISC_FEATURE: c-term amidation; lactam ring between side chains at positions 12 and 16
  MOD_RES (2)..(2): D-Ala
  MOD_RES (24)..(24): Cys-PEG
HXQGTFTSDYSKYLDERRAKDFVCWLMNT

SEQ ID NO: 262 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXQGTFTSDYSKYLDKRRAEDFVCWLMNT

SEQ ID NO: 263 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXQGTFTSDYSKYLDERAAKDFVCWLMNT

SEQ ID NO: 264 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXQGTFTSDYSKYLDERAAKDFVCWLMNT

SEQ ID NO: 265 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXQGTFTSDYSKYLDERAAQDFVCWLMNT

SEQ ID NO: 266 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring betwee side chains at positions 12 and 16
  MOD_RES (24)..(24): Cys-PEG
HXQGTFTSDYSKYLDERAAKDFVCWLMNT

SEQ ID NO: 267 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXQGTFTSDYSKYLDKRAAEDFVCWLMNT

SEQ ID NO: 268 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXQGTFTSDYSKYLDEQAAKEFICWLMNT

SEQ ID NO: 269 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring betwee side chains at positions 12 and 16
  MOD_RES (24)..(24): Cys-PEG
HXQGTFTSDYSKYLDEQAAKEFICWLMNT

SEQ ID NO: 270 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring betwee side chains at positions 16 and 20
  MOD_RES (24)..(24): Cys-PEG
HXQGTFTSDYSKYLDEQAAKEFICWLMNT

SEQ ID NO: 271 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXQGTFTSDYSKYLDEQAAKEFICWLVKG

SEQ ID NO: 272 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXQGTFTSDYSKYLDEQAAKEFICWLVKG

SEQ ID NO: 273 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXQGTFTSDYSKYLDEQAAKEFICWLVKG

SEQ ID NO: 274 - protein, 29 aa, Artificial Sequence
  Synthetic peptide
  MISC_FEATURE: c-term amidation
  MOD_RES (24)..(24): Cys-PEG
HSEGTFTSDYSKYLDERRAQDFVCWLMNT

SEQ ID NO: 275 - protein, 29 aa, Artificial Sequence
  Synthetic peptide
  MISC_FEATURE: c-term amidation
  MOD_RES (24)..(24): Cys-PEG
HSEGTFTSDYSKYLDERRAKDFVCWLMNT

SEQ ID NO: 276 - protein, 29 aa, Artificial Sequence
  Synthetic peptide
  MISC_FEATURE: c-term amidation
  MISC_FEATURE (16)..(20): Lactam ring between side chains at positions 16 and 20
  MOD_RES (24)..(24): Cys-PEG
HSEGTFTSDYSKYLDERRAKDFVCWLMNT

SEQ ID NO: 277 - protein, 29 aa, Artificial Sequence
  Synthetic peptide
  MISC_FEATURE: c-term amidation
  MISC_FEATURE (12)..(16): Lactam ring between side chains at positions 12 and 16
  MOD_RES (24)..(24): Cys-PEG
HSEGTFTSDYSKYLDERRAQDFVCWLMNT

SEQ ID NO: 278 - protein, 29 aa, Artificial Sequence
  Synthetic peptide
  MISC_FEATURE: c-term amidation
  MISC_FEATURE (12)..(16): Lactam ring between side chains at positions 12 and 16
  MOD_RES (24)..(24): Cys-PEG
HSEGTFTSDYSKYLDERRAKDFVCWLMNT

SEQ ID NO: 279 - protein, 29 aa, Artificial Sequence
  Synthetic peptide
  MISC_FEATURE: c-term amidation
  MISC_FEATURE (16)..(20): Lactam ring between side chains at positions 16 and 20
  MOD_RES (24)..(24): Cys-PEG
HSEGTFTSDYSKYLDKRRAEDFVCWLMNT

SEQ ID NO: 280 - protein, 29 aa, Artificial Sequence
  Synthetic peptide
  MISC_FEATURE: c-term amidation
  MOD_RES (24)..(24): Cys-PEG
HSEGTFTSDYSKYLDERAAKDFVCWLMNT

SEQ ID NO: 281 - protein, 29 aa, Artificial Sequence
  Synthetic peptide
  MISC_FEATURE: c-term amidation
  MISC_FEATURE (16)..(20): Lactam ring between side chains at positions 16 and 20
  MOD_RES (24)..(24): Cys-PEG
HSEGTFTSDYSKYLDERAAKDFVCWLMNT

SEQ ID NO: 282 - protein, 29 aa, Artificial Sequence
  Synthetic peptide
  MISC_FEATURE: c-term amidation
  MISC_FEATURE (12)..(16): Lactam ring between side chains at positions 12 and 16
  MOD_RES (24)..(24): Cys-PEG
HSEGTFTSDYSKYLDERAAQDFVCWLMNT

SEQ ID NO: 283 - protein, 29 aa, Artificial Sequence
  Synthetic peptide
  MISC_FEATURE: c-term amidation
  MISC_FEATURE (12)..(16): Lactam ring between side chains at positions 12 and 16
  MOD_RES (24)..(24): Cys-PEG
HSEGTFTSDYSKYLDERAAKDFVCWLMNT

SEQ ID NO: 284 - protein, 29 aa, Artificial Sequence
  Synthetic peptide
  MISC_FEATURE: c-term amidation
  MISC_FEATURE (16)..(20): Lactam ring between side chains at positions 16 and 20
  MOD_RES (24)..(24): Cys-PEG
HSEGTFTSDYSKYLDKRAAEDFVCWLMNT

SEQ ID NO: 285 - protein, 29 aa, Artificial Sequence
  Synthetic peptide
  MISC_FEATURE: c-term amidation
  MOD_RES (24)..(24): Cys-PEG
HSEGTFTSDYSKYLDEQAAKEFICWLMNT

SEQ ID NO: 286 - protein, 29 aa, Artificial Sequence
  Synthetic peptide
  MISC_FEATURE: c-term amidation
  MISC_FEATURE (12)..(16): Lactam ring between side chains at positions 12 and 16
  MOD_RES (24)..(24): Cys-PEG
HSEGTFTSDYSKYLDEQAAKEFICWLMNT

SEQ ID NO: 287 - protein, 29 aa, Artificial Sequence
  Synthetic peptide
  MISC_FEATURE: c-term amidation
  MISC_FEATURE (16)..(20): Lactam ring between side chain at positions 16 and 20
  MOD_RES (24)..(24): Cys-PEG
HSEGTFTSDYSKYLDEQAAKEFICWLMNT

SEQ ID NO: 288 - protein, 29 aa, Artificial Sequence
  Synthetic peptide
  MISC_FEATURE: c-term amidation
  MOD_RES (24)..(24): Cys-PEG
HSEGTFTSDYSKYLDEQAAKEFICWLVKG

SEQ ID NO: 289 - protein, 29 aa, Artificial Sequence
  Synthetic peptide
  MISC_FEATURE: c-term amidation
  MISC_FEATURE (12)..(16): Lactam ring between side chains at positions 12 and 16
  MOD_RES (24)..(24): Cys-PEG
HSEGTFTSDYSKYLDEQAAKEFICWLVKG

SEQ ID NO: 290 - protein, 29 aa, Artificial Sequence
  Synthetic peptide
  MISC_FEATURE: c-term amidation
  MISC_FEATURE (16)..(20): Lactam ring between side chains at positions 16 and 20
  MOD_RES (24)..(24): Cys-PEG
HSEGTFTSDYSKYLDEQAAKEFICWLVKG

SEQ ID NO: 291 - protein, 29 aa, Artificial Sequence
  Synthetic peptide
  MISC_FEATURE: c-term amidation
  MOD_RES (1)..(1): (Des-amino)His
  MOD_RES (24)..(24): Cys-PEG
XSEGTFTSDYSKYLDERRAQDFVCWLMNT

SEQ ID NO: 292 - protein, 29 aa, Artificial Sequence
  Synthetic peptide
  MISC_FEATURE: c-term amidation
  MOD_RES (1)..(1): (Des-amino)His
  MOD_RES (24)..(24): Cys-PEG
XSEGTFTSDYSKYLDERRAKDFVCWLMNT

SEQ ID NO: 293 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSEGTFTSDYSKYLDERRAKDFVCWLMNT

SEQ ID NO: 294 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSEGTFTSDYSKYLDERRAQDFVCWLMNT

SEQ ID NO: 295 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSEGTFTSDYSKYLDERRAKDFVCWLMNT

SEQ ID NO: 296 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSEGTFTSDYSKYLDKRRAEDFVCWLMNT

SEQ ID NO: 297 - protein, 29 aa, Artificial Sequence
  Synthetic peptide
  MISC_FEATURE: c-term amidation
  MOD_RES (1)..(1): (Des-amino)His
  MOD_RES (24)..(24): Cys-PEG
XSEGTFTSDYSKYLDERAAKDFVCWLMNT

SEQ ID NO: 298 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSEGTFTSDYSKYLDERAAKDFVCWLMNT

SEQ ID NO: 299 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSEGTFTSDYSKYLDERAAQDFVCWLMNT

SEQ ID NO: 300 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSEGTFTSDYSKYLDERAAKDFVCWLMNT

SEQ ID NO: 301 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSEGTFTSDYSKYLDKRAAEDFVCWLMNT

SEQ ID NO: 302 - protein, 29 aa, Artificial Sequencce
  Synthetic peptide
  MISC_FEATURE: c-term amidation
  MOD_RES (1)..(1): (Des-amino)His
  MOD_RES (24)..(24): Cys-PEG
XSEGTFTSDYSKYLDEQAAKGFICWLMNT

SEQ ID NO: 303 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSEGTFTSDYSKYLDEQAAKGFICWLMNT

SEQ ID NO: 304 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSEGTFTSDYSKYLDEQAAKGFICWLMNT

SEQ ID NO: 305 - protein, 29 aa, Artificial Sequencce
  Synthetic peptide
  MISC_FEATURE: c-term amidation
  MOD_RES (1)..(1): (des-amino)His
  MOD_RES (24)..(24): Cys-PEG
XSEGTFTSDYSKYLDEQAAKGFICWLVKG

SEQ ID NO: 306 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
  MOD_RES (24)..(24): Cys-PEG
XSEGTFTSDYSKYLDEQAAKGFICWLVKG

SEQ ID NO: 307 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
  MOD_RES (24)..(24): Cys-PEG
XSEGTFTSDYSKYLDEQAAKGFICWLVKG

SEQ ID NO: 308 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDERRAQDFVCWLMNT

SEQ ID NO: 309 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDERRAKDFVCWLMNT

SEQ ID NO: 310 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXEGTFTSDYSKYLDERRAKDFVCWLMNT

SEQ ID NO: 311 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chain at positions 12 and 16
  MOD_RES (24)..(24): Cys-PEG
HXEGTFTSDYSKYLDERRAQDFVCWLMNT

SEQ ID NO: 312 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXEGTFTSDYSKYLDERRAKDFVCWLMNT

SEQ ID NO: 313 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXEGTFTSDYSKYLDKRRAEDFVCWLMNT

SEQ ID NO: 314 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDERAAKDFVCWLMNT

SEQ ID NO: 315 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between seide chains at positions 16 and 20
  MOD_RES (24)..(24): Cys-PEG
HXEGTFTSDYSKYLDERAAKDFVCWLMNT

SEQ ID NO: 316 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXEGTFTSDYSKYLDERAAQDFVCWLMNT

SEQ ID NO: 317 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 adn 16
  MOD_RES (24)..(24): Cys-PEG
HXEGTFTSDYSKYLDERAAKDFVCWLMNT

SEQ ID NO: 318 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXEGTFTSDYSKYLDKRAAEDFVCWLMNT

SEQ ID NO: 319 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDEQAAKEFICWLMNT

SEQ ID NO: 320 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXEGTFTSDYSKYLDEQAAKEFICWLMNT

SEQ ID NO: 321 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at position 16 and 20
  MOD_RES (24)..(24): Cys-PEG
HXEGTFTSDYSKYLDEQAAKEFICWLMNT

SEQ ID NO: 322 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXEGTFTSDYSKYLDEQAAKEFICWLVKG

SEQ ID NO: 323 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
  MOD_RES (24)..(24): Cys-PEG
HXEGTFTSDYSKYLDEQAAKEFICWLVKG

SEQ ID NO: 324 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at position 16 and 20
  MOD_RES (24)..(24): Cys-PEG
HXEGTFTSDYSKYLDEQAAKEFICWLVKG

SEQ ID NO: 325 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDERRAQDFVCWLMNT

SEQ ID NO: 326 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDERRAKDFVCWLMNT

SEQ ID NO: 327 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXEGTFTSDYSKYLDERRAKDFVCWLMNT

SEQ ID NO: 328 - protein, 29 aa, Artificial Sequence
  Synthetic peptide
  MISC_FEATURE: c-term amidation
  MOD_RES (2)..(2): D-Ala
  MISC_FEATURE (12)..(16): Lactam between side chains at positions 12 and 16
  MOD_RES (24)..(24): Cys-PEG
HXEGTFTSDYSKYLDERRAQDFVCWLMNT

SEQ ID NO: 329 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXEGTFTSDYSKYLDERRAKDFVCWLMNT

SEQ ID NO: 330 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXEGTFTSDYSKYLDKRRAEDFVCWLMNT

SEQ ID NO: 331 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDERAAKDFVCWLMNT

SEQ ID NO: 332 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXEGTFTSDYSKYLDERAAKDFVCWLMNT

SEQ ID NO: 333 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXEGTFTSDYSKYLDERAAQDFVCWLMNT

SEQ ID NO: 334 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXEGTFTSDYSKYLDERAAKDFVCWLMNT

SEQ ID NO: 335 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chainst at positions 16 and 20
  MOD_RES (24)..(24): Cys-PEG
HXEGTFTSDYSKYLDKRAAEDFVCWLMNT

SEQ ID NO: 336 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDEQAAKEFICWLMNT

SEQ ID NO: 337 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXEGTFTSDYSKYLDEQAAKEFICWLMNT

SEQ ID NO: 338 - protein, 29 aa, Artificial Sequence
  Synthetic peptide
  MISC_FEATURE: c-term amidation
  MOD_RES (2)..(2): D-Ala
  MISC_FEATURE (16)..(20): Lactam right between side chains at positions 16 and 20
  MOD_RES (24)..(24): Cys-PEG
HXEGTFTSDYSKYLDEQAAKEFICWLMNT

SEQ ID NO: 339 - protein, 29 aa, Artificial Sequence
  Synthetic peptide
  MISC_FEATURE: c-term amidation
  MOD_RES (2)..(2): D-Ala
  MOD_RES (24)..(24): Cys-PEG
HXEGTFTSDYSKYLDEQAAKEFICWLVKG

SEQ ID NO: 340 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
  MOD_RES (24)..(24): Cys-PEG
HXEGTFTSDYSKYLDEQAAKEFICWLVKG

SEQ ID NO: 341 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
  MOD_RES (24)..(24): Cys-PEG
HXEGTFTSDYSKYLDEQAAKEFICWLVKG

SEQ ID NO: 342 - protein, 29 aa, Artificial Sequence
  Synthetic peptide
  MISC_FEATURE: c-term amidation
  MOD_RES (16)..(16): Cys-PEG
HSQGTFTSDYSKYLDCRRAKDFVQWLMNT

SEQ ID NO: 343 - protein, 29 aa, Artificial Sequence
  Synthetic peptide
  MISC_FEATURE: c-term amidation
  MOD_RES (16)..(16): Cys-PEG
HSQGTFTSDYSKYLDCRAAKDFVQWLMNT

SEQ ID NO: 344 - protein, 29 aa, Artificial Sequence
  Synthetic peptide
  MISC_FEATURE: c-term amidation
  MOD_RES (16)..(16): Cys-PEG
HSQGTFTSDYSKYLDCQAAKEFIAWLMNT

SEQ ID NO: 345 - protein, 29 aa, Artificial Sequence
  Synthetic peptide
  MISC_FEATURE: c-term amidation
  MOD_RES (16)..(16): Cys-PEG
HSQGTFTSDYSKYLDCQAAKEFIAWLVKG

SEQ ID NO: 346 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCRRAKDFVQWLMNT

SEQ ID NO: 347 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCRAAKDFVQWLMNT

SEQ ID NO: 348 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCQAAKEFIAWLMNT

SEQ ID NO: 349 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCQAAKEFIAWLVKG

SEQ ID NO: 350 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSQGTFTSDYSKYLDCQAAKEFIAWLMNT

SEQ ID NO: 351 - protein, 29 aa, Artificial Sequence
  Synthetic peptide
  MISC_FEATURE: c-term amidation
  MOD_RES (2)..(2): Aminoisobutyric acid
  MOD_RES (16)..(16): Cys-PEG
HXQGTFTSDYSKYLDCRAAKDFVQWLMNT

SEQ ID NO: 352 - protein, 29 aa, Artificial Sequence
  Synthetic peptide
  MISC_FEATURE: c-term amidation
  MOD_RES (2)..(2): Aminoisobutyric acid
  MOD_RES (16)..(16): Cys-PEG
HXQGTFTSDYSKYLDCQAAKEFIAWLMNT

SEQ ID NO: 353 - protein, 29 aa, Artificial Sequence
  Synthetic peptide
  MISC_FEATURE: c-term amidation
  MOD_RES (2)..(2): Aminoisobutyric acid
  MOD_RES (16)..(16): Cys-PEG
HXQGTFTSDYSKYLDCQAAKEFIAWLVKG

SEQ ID NO: 354 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXQGTFTSDYSKYLDCRRAKDFVQWLMNT

SEQ ID NO: 355 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXQGTFTSDYSKYLDCRAAKDFVQWLMNT

SEQ ID NO: 356 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXQGTFTSDYSKYLDCQAAKEFIAWLMNT

SEQ ID NO: 357 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXQGTFTSDYSKYLDCQAAKEFIAWLVKG

SEQ ID NO: 358 - protein, 29 aa, Artificial Sequence
  Synthetic peptide
  MISC_FEATURE: c-term amidation
  MOD_RES (16)..(16): Cys-PEG
HSEGTFTSDYSKYLDCRRAKDFVQWLMNT

SEQ ID NO: 359 - protein, 29 aa, Artificial Sequence
  Synthetic peptide
  MISC_FEATURE: c-term amidation
  MOD_RES (16)..(16): Cys-PEG
HSEGTFTSDYSKYLDCRAAKDFVQWLMNT

SEQ ID NO: 360 - protein, 29 aa, Artificial Sequence
  Synthetic peptide
  MISC_FEATURE: c-term amidation
  MOD_RES (16)..(16): Cys-PEG
HSEGTFTSDYSKYLDCQAAKEFIAWLMNT

SEQ ID NO: 361 - protein, 29 aa, Artificial Sequence
  Synthetic peptide
  MISC_FEATURE: c-term amidation
  MOD_RES (16)..(16): Cys-PEG
HSEGTFTSDYSKYLDCQAAKEFIAWLVKG

SEQ ID NO: 362 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSEGTFTSDYSKYLDCRRAKDFVQWLMNT

SEQ ID NO: 363 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSEGTFTSDYSKYLDCRAAKDFVQWLMNT

SEQ ID NO: 364 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSEGTFTSDYSKYLDCQAAKEFIAWLMNT

SEQ ID NO: 365 - protein, 29 aa, Artificial Sequence
  Synthetic peptide
  MISC_FEATURE: c-term amidation
  MOD_RES (1)..(1): (Des-amino)His
  MOD_RES (16)..(16): Cys-PEG
XSEGTFTSDYSKYLDCQAAKEFIAWLVKG

SEQ ID NO: 366 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCRRAKDFVQWLMNT

SEQ ID NO: 367 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCRAAKDFVQWLMNT

SEQ ID NO: 368 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCQAAKEFIAWLMNT

SEQ ID NO: 369 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCQAAKEFIAWLVKG

SEQ ID NO: 370 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCRRAKDFVQWLMNT

SEQ ID NO: 371 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCRAAKDFVQWLMNT

SEQ ID NO: 372 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCQAAKEFIAWLMNT

SEQ ID NO: 373 - protein, 29 aa, Artificial Sequence
  Synthetic peptide
  MISC_FEATURE: c-term amidation
  MOD_RES (2)..(2): D-Ala
  MOD_RES (16)..(16): Cys-PEG
HXEGTFTSDYSKYLDCQAAKEFIAWLVKG

SEQ ID NO: 374 - protein, 29 aa, Artificial Sequence
  Synthetic peptide
  MISC_FEATURE: c-term amidation
HSQGTFTSDYSKYLDERRAQDFVQWLMDT

SEQ ID NO: 375 - protein, 29 aa, Artificial Sequence
  Synthetic peptide
  MISC_FEATURE: c-term amidation
HSQGTFTSDYSKYLDERRAKDFVQWLMDT

SEQ ID NO: 376 - protein, 29 aa, Artificial Sequence
  Synthetic peptide
  MISC_FEATURE: c-term amidation
  MISC_FEATURE (16)..(20): Lactam ring between side chains at positions 16 and 20
HSQGTFTSDYSKYLDERRAKDFVQWLMDT

SEQ ID NO: 377 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDERRAQDFVQWLMDT

SEQ ID NO: 378 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDERRAKDFVQWLMDT

SEQ ID NO: 379 - protein, 29 aa, Artificial Sequence
  Synthetic peptide
  MISC_FEATURE: c-term amidation
  MISC_FEATURE (16)..(20): Lactam ring between side chains at positions 16 and 20
HSQGTFTSDYSKYLDKRRAEDFVQWLMDT

SEQ ID NO: 380 - protein, 29 aa, Artificial Sequence
  Synthetic peptide
  MISC_FEATURE: c-term amidation
HSQGTFTSDYSKYLDERAAKDFVQWLMDT

SEQ ID NO: 381 - protein, 29 aa, Artificial Sequence
  Synthetic peptide
  MISC_FEATURE: c-term amidation; lactam ring between side chains at positions 16 and 20
HSQGTFTSDYSKYLDERAAKDFVQWLMDT

SEQ ID NO: 382 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDERAAQDFVQWLMDT

SEQ ID NO: 383 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDERAAKDFVQWLMDT

SEQ ID NO: 384 - protein, 29 aa, Artificial Sequence
  Synthetic peptide
  MISC_FEATURE: c-term amidation
  MISC_FEATURE (16)..(20): Lactam ring between side chains at positions 16 and 20
HSQGTFTSDYSKYLDKRAAEDFVQWLMDT

SEQ ID NO: 385 - protein, 29 aa, Artificial Sequence
  Synthetic peptide
  MISC_FEATURE: c-term amidation
HSQGTFTSDYSKYLDEQAAKEFIAWLMDT

SEQ ID NO: 386 - protein, 29 aa, Artificial Sequence
  Synthetic peptide
  MISC_FEATURE: c-term amidation
  MISC_FEATURE (12)..(16): Lactam ring between side chains at positions 12 and 16
HSQGTFTSDYSKYLDEQAAKEFIAWLMDT

SEQ ID NO: 387 - protein, 29 aa, Artificial Sequence
  Synthetic peptide
  MISC_FEATURE: c-term amidation
  MISC_FEATURE (16)..(20): Lactam ring between side chains at positions 16 and 20
HSQGTFTSDYSKYLDEQAAKEFIAWLMDT

SEQ ID NO: 388 - protein, 29 aa, Artificial Sequence
  Synthetic peptide
  MISC_FEATURE: c-term amidation
  MOD_RES (1)..(1): (Des-amino)His
XSQGTFTSDYSKYLDERRAQDFVQWLMDT

SEQ ID NO: 389 - protein, 29 aa, Artificial Sequence
  Synthetic peptide
  MISC_FEATURE: c-term amidation
  MOD_RES (1)..(1): (Des-amino)His
XSQGTFTSDYSKYLDERRAKDFVQWLMDT

SEQ ID NO: 390 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDERRAKDFVQWLMDT

SEQ ID NO: 391 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERRAQDFVQWLMDT

SEQ ID NO: 392 - protein, 29 aa, Artificial Sequence
  Synthetic peptide
  misc_feature (1)..(1): Xaa can be any naturally occurring amino acid
XSQGTFTSDYSKYLDERRAKDFVQWLMDT

SEQ ID NO: 393 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDKRRAEDFVQWLMDT

SEQ ID NO: 394 - protein, 29 aa, Artificial Sequence
  Synthetic peptide
  MISC_FEATURE: c-term amidation
  MOD_RES (1)..(1): (Des-amino)His
XSQGTFTSDYSKYLDERAAKDFVQWLMDT

SEQ ID NO: 395 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDERAAKDFVQWLMDT

SEQ ID NO: 396 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERAAQDFVQWLMDT

SEQ ID NO: 397 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDERAAKDFVQWLMDT

SEQ ID NO: 398 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDKRAAEDFVQWLMDT

SEQ ID NO: 399 - protein, 29 aa, Artificial Sequence
  Synthetic peptide
  MISC_FEATURE: c-term amidation
  MOD_RES (1)..(1): (Des-amino)His
XSQGTFTSDYSKYLDEQAAKEFIAWLMDT

SEQ ID NO: 400 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSQGTFTSDYSKYLDEQAAKEFIAWLMDT

SEQ ID NO: 401 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSQGTFTSDYSKYLDEQAAKEFIAWLMDT

SEQ ID NO: 402 - protein, 29 aa, Artificial Sequence
  Synthetic peptide
  MISC_FEATURE: c-term amidation
  MOD_RES (2)..(2): Aminoisobutyric acid
HXQGTFTSDYSKYLDERRAQDFVQWLMDT

SEQ ID NO: 403 - protein, 29 aa, Artificial Sequence
  Synthetic peptide
  MISC_FEATURE: c-term amidation
  MOD_RES (2)..(2): Aminoisobutyric acid
HXQGTFTSDYSKYLDERRAKDFVQWLMDT

SEQ ID NO: 404 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDERRAKDFVQWLMDT

SEQ ID NO: 405 - protein, 29 aa, Artificial Sequence
  Synthetic peptide
  MISC_FEATURE: c-term amidation
  MOD_RES (2)..(2): aminoisobutyric acid
  MISC_FEATURE (12)..(16): Lactam ring between side chains at positions 12 and 16
HXQGTFTSDYSKYLDERRAQDFVQWLMDT

SEQ ID NO: 406 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXQGTFTSDYSKYLDERRAKDFVQWLMDT

SEQ ID NO: 407 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDKRRAEDFVQWLMDT

SEQ ID NO: 408 - protein, 29 aa, Artificial Sequence
  Synthetic peptide
  MOD_RES (2)..(2): Aminoisobutyric acid
  MISC_FEATURE (2)..(2): c-term amidation
HXQGTFTSDYSKYLDERAAKDFVQWLMDT

SEQ ID NO: 409 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDERAAKDFVQWLMDT

SEQ ID NO: 410 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXQGTFTSDYSKYLDERAAQDFVQWLMDT

SEQ ID NO: 411 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXQGTFTSDYSKYLDERAAKDFVQWLMDT

SEQ ID NO: 412 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 16 and 20
HXQGTFTSDYSKYLDKRAAEDFVQWLMDT

SEQ ID NO: 413 - protein, 29 aa, Artificial Sequence
  Synthetic peptide
  MISC_FEATURE: c-term amidation
  MOD_RES (2)..(2): Aminoisobutyric acid
HXQGTFTSDYSKYLDEQAAKEFIAWLMDT

SEQ ID NO: 414 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXQGTFTSDYSKYLDEQAAKEFIAWLMDT

SEQ ID NO: 415 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXQGTFTSDYSKYLDEQAAKEFIAWLMDT

SEQ ID NO: 416 - protein, 29 aa, Artificial Sequence
  Synthetic peptide
  MISC_FEATURE: c-term amidation
  MOD_RES (2)..(2): D-Ala
HXQGTFTSDYSKYLDERRAQDFVQWLMDT

SEQ ID NO: 417 - protein, 29 aa, Artificial Sequence
  Synthetic peptide
  MISC_FEATURE: c-term amidation
  MOD_RES (2)..(2): D-Ala
HXQGTFTSDYSKYLDERRAKDFVQWLMDT

SEQ ID NO: 418 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDERRAKDFVQWLMDT

SEQ ID NO: 419 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERRAQDFVQWLMDT

SEQ ID NO: 420 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERRAKDFVQWLMDT

SEQ ID NO: 421 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDKRRAEDFVQWLMDT

SEQ ID NO: 422 - protein, 29 aa, Artificial Sequence
  Synthetic peptide
  MISC_FEATURE: c-term amidation
  MOD_RES (2)..(2): D-Ala
HXQGTFTSDYSKYLDERAAKDFVQWLMDT

SEQ ID NO: 423 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDERAAKDFVQWLMDT

SEQ ID NO: 424 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERAAQDFVQWLMDT

SEQ ID NO: 425 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDERAAKDFVQWLMDT

SEQ ID NO: 426 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDKRAAEDFVQWLMDT

SEQ ID NO: 427 - protein, 29 aa, Artificial Sequence
  Synthetic peptide
  MISC_FEATURE: c-term amidation
  MOD_RES (2)..(2): D-Ala
HXQGTFTSDYSKYLDEQAAKEFIAWLMDT

SEQ ID NO: 428 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXQGTFTSDYSKYLDEQAAKEFIAWLMDT

SEQ ID NO: 429 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXQGTFTSDYSKYLDEQAAKEFIAWLMDT

SEQ ID NO: 430 - protein, 29 aa, Artificial Sequence
  Synthetic peptide
  MISC_FEATURE: c-term amidation
HSEGTFTSDYSKYLDERRAQDFVQWLMDT

SEQ ID NO: 431 - protein, 29 aa, Artificial Sequence
  Synthetic peptide
  MISC_FEATURE: c-term amidation
HSEGTFTSDYSKYLDERRAKDFVQWLMDT

SEQ ID NO: 432 - protein, 29 aa, Artificial Sequence
  Synthetic peptide
  MISC_FEATURE: c-term amidation
  MISC_FEATURE (16)..(20): Lactam ring between side chains at positions 16 and 20
HSEGTFTSDYSKYLDERRAKDFVQWLMDT

SEQ ID NO: 433 - protein, 29 aa, Artificial Sequence
  Synthetic peptide
  MISC_FEATURE: c-term amidation
  MISC_FEATURE (16)..(16): Lactam ring between side chains at positions 12 and 16
HSEGTFTSDYSKYLDERRAQDFVQWLMDT

SEQ ID NO: 434 - protein, 29 aa, Artificial Sequence
  Synthetic peptide
  MISC_FEATURE: c-term amidation
  MISC_FEATURE (12)..(16): Lactam ring between side chains at positions 12 and 16
HSEGTFTSDYSKYLDERRAKDFVQWLMDT

SEQ ID NO: 435 - protein, 29 aa, Artificial Sequence
  Synthetic peptide
  MISC_FEATURE: c-term amidation
  MISC_FEATURE (16)..(20): Lactam ring between side chains at positions 16 and 20
HSEGTFTSDYSKYLDKRRAEDFVQWLMDT

SEQ ID NO: 436 - protein, 29 aa, Artificial Sequence
  Synthetic peptide
  MISC_FEATURE: c-term amidation
HSEGTFTSDYSKYLDERAAKDFVQWLMDT

SEQ ID NO: 437 - protein, 29 aa, Artificial Sequence
  Synthetic peptide
  MISC_FEATURE: c-term amidation
  MISC_FEATURE: Lactam ring between side chains at positions 16 and 20
HSEGTFTSDYSKYLDERAAKDFVQWLMDT

SEQ ID NO: 438 - protein, 29 aa, Artificial Sequence
  Synthetic peptide
  MISC_FEATURE: c-term amidation
  MISC_FEATURE (12)..(16): Lactam ring between side chains at positions 12 and 16
HSEGTFTSDYSKYLDERAAQDFVQWLMDT

SEQ ID NO: 439 - protein, 29 aa, Artificial Sequence
  Synthetic peptide
  MISC_FEATURE: c-term amidation
  MISC_FEATURE (12)..(16): Lactam ring between side chains at positions 12 and 16
HSEGTFTSDYSKYLDERAAKDFVQWLMDT

SEQ ID NO: 440 - protein, 29 aa, Artificial Sequence
  Synthetic peptide
  MISC_FEATURE: c-term amidation
  MISC_FEATURE (16)..(20): Lactam ring between side chains at positions 16 and 20
HSEGTFTSDYSKYLDKRAAEDFVQWLMDT

SEQ ID NO: 441 - protein, 29 aa, Artificial Sequence
  Synthetic peptide
  MISC_FEATURE: c-term amidation
HSEGTFTSDYSKYLDEQAAKEFIAWLMDT

SEQ ID NO: 442 - protein, 29 aa, Artificial Sequence
  Synthetic peptide
  MISC_FEATURE: c-term amidation
  MISC_FEATURE (12)..(16): Lactam ring between side chains at positions 12 and 16
HSEGTFTSDYSKYLDEQAAKEFIAWLMDT

SEQ ID NO: 443 - protein, 29 aa, Artificial Sequence
  Synthetic peptide
  MISC_FEATURE: c-term amidation
  MISC_FEATURE (16)..(20): Lactam ring between side chains at positions 16 and 20
HSEGTFTSDYSKYLDEQAAKEFIAWLMDT

SEQ ID NO: 444 - protein, 29 aa, Artificial Sequence
  Synthetic peptide
  MISC_FEATURE: c-term amidation
  MOD_RES (1)..(1): (Des-amino)His
XSEGTFTSDYSKYLDERRAQDFVQWLMDT

SEQ ID NO: 445 - protein, 29 aa, Artificial Sequence
  Synthetic peptide
  MISC_FEATURE: c-term amidation
  MOD_RES (1)..(1): (Des-amino)His
XSEGTFTSDYSKYLDERRAKDFVQWLMDT

SEQ ID NO: 446 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDERRAKDFVQWLMDT

SEQ ID NO: 447 - protein, 29 aa, Artificial Sequence
  Synthetic peptide
  MISC_FEATURE: c-term amidation
  MISC_FEATURE: Lactam ring between side chains at positions 12 and 16
  MOD_RES (1)..(1): (Des-amino)His
XSEGTFTSDYSKYLDERRAQDFVQWLMDT

SEQ ID NO: 448 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDERRAKDFVQWLMDT

SEQ ID NO: 449 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDKRRAEDFVQWLMDT

SEQ ID NO: 450 - protein, 29 aa, Artificial Sequence
  Synthetic peptide
  MISC_FEATURE: c-term amidation
  MOD_RES (1)..(1): (Des-amino)His
XSEGTFTSDYSKYLDERAAKDFVQWLMDT

SEQ ID NO: 451 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDERAAKDFVQWLMDT

SEQ ID NO: 452 - protein, 29 aa, Artificial Sequence
  Synthetic peptide
  MISC_FEATURE: C-term amidation
  MOD_RES (1)..(1): (Des-amino)His
  MISC_FEATURE (12)..(16): Lactam ring between side chains at positions 12 and 16
XSEGTFTSDYSKYLDERAAQDFVQWLMDT

SEQ ID NO: 453 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDERAAKDFVQWLMDT

SEQ ID NO: 454 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDKRAAEDFVQWLMDT

SEQ ID NO: 455 - protein, 29 aa, Artificial Sequence
  Synthetic peptide
  MISC_FEATURE: c-term amidation
  MOD_RES (1)..(1): (Des-amino)His
XSEGTFTSDYSKYLDEQAAKEFIAWLMDT

SEQ ID NO: 456 - protein, 29 aa, Artificial Sequence
  Synthetic peptide
  MISC_FEATURE: c-term amidation
  MOD_RES (1)..(1): (Des-amino)His
  MISC_FEATURE (12)..(16): Lactam ring between side chains at positions 12 and 16
XSEGTFTSDYSKYLDEQAAKEFIAWLMDT

SEQ ID NO: 457 - protein, 29 aa, Artificial Sequence
  Synthetic peptide
  MISC_FEATURE: c-term amidation
  MOD_RES (1)..(1): (Des-amino)His
  MISC_FEATURE (16)..(20): Lactam ring between side chains at positions 16 and 20
XSEGTFTSDYSKYLDEQAAKEFIAWLMDT

SEQ ID NO: 458 - protein, 29 aa, Artificial Sequence
  Synthetic peptide
  MISC_FEATURE: c-term amidation
  MOD_RES (2)..(2): Aminoisobutyric acid
HXEGTFTSDYSKYLDERRAQDFVQWLMDT

SEQ ID NO: 459 - protein, 29 aa, Artificial Sequence
  Synthetic peptide
  MISC_FEATURE: c-term amidation
  MOD_RES (2)..(2): Aminoisobutyric acid
HXEGTFTSDYSKYLDERRAKDFVQWLMDT

SEQ ID NO: 460 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDERRAKDFVQWLMDT

SEQ ID NO: 461 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERRAQDFVQWLMDT

SEQ ID NO: 462 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERRAKDFVQWLMDT

SEQ ID NO: 463 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDKRRAEDFVQWLMDT

SEQ ID NO: 464 - protein, 29 aa, Artificial Sequence
  Synthetic peptide
  MISC_FEATURE: c-term amidation
  MOD_RES (2)..(2): Aminoisobutyric acid
HXEGTFTSDYSKYLDERAAKDFVQWLMDT

SEQ ID NO: 465 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDERAAKDFVQWLMDT

SEQ ID NO: 466 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at postions 12 and 16
HXEGTFTSDYSKYLDERAAQDFVQWLMDT

SEQ ID NO: 467 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDERAAKDFVQWLMDT

SEQ ID NO: 468 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 16 and 20
HXEGTFTSDYSKYLDKRAAEDFVQWLMDT

SEQ ID NO: 469 - protein, 29 aa, Artificial Sequence
  Synthetic peptide
  MISC_FEATURE: c-term amidation
  MOD_RES (2)..(2): Aminoisobutyric acid
HXEGTFTSDYSKYLDEQAAKEFIAWLMDT

SEQ ID NO: 470 - protein, 29 aa, Artificial Sequence
  Synthetic peptide
  MISC_FEATURE: c-term amidation
  MOD_RES (2)..(2): Aminoisobutyric acid
  MISC_FEATURE (12)..(16): Lactam ring between side chains at positions 12 and 16
HXEGTFTSDYSKYLDEQAAKEFIAWLMDT

SEQ ID NO: 471 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
HXEGTFTSDYSKYLDEQAAKEFIAWLMDT

SEQ ID NO: 472 - protein, 29 aa, Artificial Sequence
  Synthetic peptide
  MISC_FEATURE: c-term amidation
  MOD_RES (2)..(2): D-Ala
HXEGTFTSDYSKYLDERRAQDFVQWLMDT

SEQ ID NO: 473 - protein, 29 aa, Artificial Sequence
  Synthetic peptide
  MISC_FEATURE: c-term amidation
  MOD_RES (2)..(2): D-Ala
HXEGTFTSDYSKYLDERRAKDFVQWLMDT

SEQ ID NO: 474 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDERRAKDFVQWLMDT

SEQ ID NO: 475 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERRAQDFVQWLMDT

SEQ ID NO: 476 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERRAKDFVQWLMDT

SEQ ID NO: 477 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDKRRAEDFVQWLMDT

SEQ ID NO: 478 - protein, 29 aa, Artificial Sequence
  Synthetic peptide
  MISC_FEATURE: c-term amidation
  MOD_RES (2)..(2): D-Ala
HXEGTFTSDYSKYLDERAAKDFVQWLMDT

SEQ ID NO: 479 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDERAAKDFVQWLMDT

SEQ ID NO: 480 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERAAQDFVQWLMDT

SEQ ID NO: 481 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDERAAKDFVQWLMDT

SEQ ID NO: 482 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDKRAAEDFVQWLMDT

SEQ ID NO: 483 - protein, 29 aa, Artificial Sequence
  Synthetic peptide
  MISC_FEATURE: c-term amidation
  MOD_RES (2)..(2): D-Ala
HXEGTFTSDYSKYLDEQAAKEFIAWLMDT

SEQ ID NO: 484 - protein, 29 aa, Artificial Sequence
  Synthetic peptide
  MISC_FEATURE: c-term amidation
  MOD_RES (2)..(2): D-Ala
  MISC_FEATURE (12)..(16): Lactam ring between side chains at positions 12 and 16
HXEGTFTSDYSKYLDEQAAKEFIAWLMDT

SEQ ID NO: 485 - protein, 29 aa, Artificial Sequence
  Synthetic peptide
  MISC_FEATURE: c-term amidation
  MOD_RES (2)..(2): D-Ala
  MISC_FEATURE (16)..(20): Lactam ring between side chains at positions 16 and 20
HXEGTFTSDYSKYLDEQAAKEFIAWLMDT

SEQ ID NO: 486 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDEQAAKEFICWLMNT

SEQ ID NO: 487 - protein, 29 aa, Artificial Sequence
  Synthetic peptide
  MISC_FEATURE: c-term amidation
  MOD_RES (2)..(2): Aminoisobutyric acid
  MOD_RES (29)..(29): Cys-PEG
HXQGTFTSDYSKYLDEQAAKEFIAWLMNC

SEQ ID NO: 488 - protein, 40 aa, Artificial Sequence
  Synthetic peptide
  MISC_FEATURE: c-term amidation
  MOD_RES (2)..(2): Aminoisobutyric acid
  MOD_RES (40)..(40): Cys-PEG
HXQGTFTSDYSKYLDEQAAKEFIAWLMNGGPSSGAPPPSC

SEQ ID NO: 489 - protein, 40 aa, Artificial Sequence; identical to SEQ ID NO: 488
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (40)..(40): Cys-PEG

SEQ ID NO: 490 - protein, 39 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDEQAAKEFICWLMNGGPSSGAPPPS

SEQ ID NO: 491 - protein, 39 aa, Artificial Sequence; identical to SEQ ID NO: 490
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG

SEQ ID NO: 492 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERAAKDFVCWLMNT

SEQ ID NO: 493 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERAAKDFVQWLMNC

SEQ ID NO: 494 - protein, 40 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERAAKDFVQWLMNGGPSSGAPPPSC

SEQ ID NO: 495 - protein, 40 aa, Artificial Sequence; identical to SEQ ID NO: 494
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (40)..(40): Cys-PEG

SEQ ID NO: 496 - protein, 39 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERAAKDFVCWLMNGGPSSGAPPPS

SEQ ID NO: 497 - protein, 39 aa, Artificial Sequence; identical to SEQ ID NO: 496
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG

SEQ ID NO: 498 - protein, 30 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERRAKDFVCWLMNTA

SEQ ID NO: 499 - protein, 29 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERRAKDFVQWLMNC

SEQ ID NO: 500 - protein, 40 aa, Artificial Sequence
  Synthetic peptide
  MISC_FEATURE: c-term amidation
  MOD_RES (2)..(2): Aminoisobutyric acid
  MOD_RES (40)..(40): Cys-PEG
HXQGTFTSDYSKYLDERRAKDFVQWLMNGGPSSGAPPPSC

SEQ ID NO: 501 - protein, 40 aa, Artificial Sequence; identical to SEQ ID NO: 500
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (40)..(40): Cys-PEG

SEQ ID NO: 502 - protein, 39 aa, Artificial Sequence
  Synthetic peptide
  MISC_FEATURE: c-term amidation
  MOD_RES (2)..(2): Aminoisobutyric acid
  MOD_RES (24)..(24): Cys-PEG
HXQGTFTSDYSKYLDERRAKDFVCWLMNGGPSSGAPPPS

SEQ ID NO: 503 - protein, 39 aa, Artificial Sequence; identical to SEQ ID NO: 502
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG

SEQ ID NO: 504 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDEQAAKEFICWLMNT

SEQ ID NO: 505 - protein, 29 aa, Artificial Sequence
  Synthetic peptide
  MISC_FEATURE: c-term amidation
  MOD_RES (1)..(1): Alpha, Alpha-Dimethyl Imidiazole Acetic Acid
  MISC_FEATURE (16)..(20): Lactam ring between side chains at positions 16 and 20
  MOD_RES (24)..(24): Cys-PEG
XSQGTFTSDYSKYLDEQAAKEFICWLMNT

SEQ ID NO: 506 - protein, 29 aa, Artificial Sequence
  Synthetic peptide
  MISC_FEATURE: c-term amidation
  MOD_RES (1)..(1): Alpha, Alpha-Dimethly Imidiazole Acetic Acid
  MOD_RES (1)..(1): Alpha, Alpha-Dimethly Imidiazole Acetic Acid
  MISC_FEATURE (16)..(20): Lactam ring between side chains at positions 16 and 20
  MOD_RES (29)..(29): Cys-PEG
XSQGTFTSDYSKYLDEQAAKEFIAWLMNC

SEQ ID NO: 507 - protein, 40 aa, Artificial Sequence
  Synthetic peptide
  MISC_FEATURE: c-term amidation
  MOD_RES (1)..(1): Alpha, Alpha Dimethyl Imidiazole Acetic Acid
  MISC_FEATURE (16)..(20): Lactam ring between side chains at positions 16 and 20
  MOD_RES (40)..(40): Cys-PEG
XSQGTFTSDYSKYLDEQAAKEFIAWLMNGGPSSGAPPPSC

SEQ ID NO: 508 - protein, 40 aa, Artificial Sequence
  Synthetic peptide
  MISC_FEATURE: c-term amidation
  MOD_RES (1)..(1): Alpha, Alpha Dimethyl Imidiazole Acetic Acid
  MISC_FEATURE (16)..(20): Lactam ring between side chains at positions 16 and 20
  MOD_RES (40)..(40): Cys-PEG
XSQGTFTSDYSKYLDERRAKDFVQWLMNGGPSSGAPPPSC

SEQ ID NO: 509 - protein, 39 aa, Artificial Sequence
  Synthetic peptide
  MISC_FEATURE: c-term amidation
  MOD_RES (1)..(1): Alpha, Alpha Dimethyl Imidiazole Acetic Acid
  MISC_FEATURE (16)..(20): Lactam ring between side chains at positions 16 and 20
  MOD_RES (24)..(24): Cys-PEG
XSQGTFTSDYSKYLDEQAAKEFICWLMNGGPSSGAPPPS

SEQ ID NO: 510 - protein, 29 aa, Artificial Sequence
  Synthetic peptide
  MISC_FEATURE: c-term amidation
  MOD_RES (1)..(1): Alpha, Alpha Dimethyl Imidiazole Acetic Acid
  misc_feature (2)..(2): Xaa can be any naturally occurring amino acid
  MISC_FEATURE (16)..(20): Lactam ring between side chains at positions 16 and 20
  MOD_RES (24)..(24): Cys-PEG
HXQGTFTSDYSKYLDERRAKDFVCWLMNT

SEQ ID NO: 511 - protein, 29 aa, Artificial Sequence
  Synthetic peptide
  MISC_FEATURE: c-term amidation
  MOD_RES (2)..(2): Alpha, Alpha Dimethyl Imidiazole Acetic Acid
  MISC_FEATURE (16)..(20): Lactam ring between side chains at positions 16 and 20
  MOD_RES (24)..(24): Cys-PEG
HXQGTFTSDYSKYLDERRAKDFVCWLMNT

SEQ ID NO: 512 - protein, 29 aa, Artificial Sequence
  Synthetic peptide
  MISC_FEATURE: c-term amidation
  MOD_RES (1)..(1): Alpha, Alpha Dimethyl Imidiazole Acetic Acid
  MISC_FEATURE (16)..(20): Lactam ring between side chains at positions 16 and 20
  MOD_RES (29)..(29): Cys-PEG
XSQGTFTSDYSKYLDERRAKDFVQWLMNC

SEQ ID NO: 513 - protein, 39 aa, Artificial Sequence
  Synthetic peptide
  MISC_FEATURE: c-term amidation
  MOD_RES (1)..(1): Alpha, Alpha Dimethyl Imidiazole Acetic Acid
  MISC_FEATURE (16)..(20): Lactam ring between side chains at positions 16 and 20
  MOD_RES (24)..(24): Cys-PEG
XSQGTFTSDYSKYLDERRAKDFVCWLMNGGPSSGAPPPS

SEQ ID NO: 514 - protein, 29 aa, Artificial Sequence
  Synthetic peptide
  MISC_FEATURE: c-term amidation
  MISC_FEATURE (16)..(20): Lactam ring between side chains at positions 16 and 20
  MOD_RES (24)..(24): Cys-PEG
HSQGTFTSDYSKYLDEQAAKEFICWLMNT

SEQ ID NO: 515 - protein, 11 aa, Artificial Sequence
  Synthetic peptide
GGPSSGAPPPS

SEQ ID NO: 516 - protein, 12 aa, Artificial Sequence
  Synthetic peptide
  MOD_RES (12)..(12): Cys-PEG
GGPSSGAPPPSC

SEQ ID NO: 517 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDERRAKDFVCWLMNT

SEQ ID NO: 518 - protein, 29 aa, Artificial Sequence
  Synthetic peptide
  MISC_FEATURE: c-term amidation
  MOD_RES (24)..(24): Cys-PEG
HSQGTFTSDYSKYLDEQAAKEFICWLMNT

SEQ ID NO: 519 - protein, 29 aa, Artificial Sequence
  Synthetic peptide
  MISC_FEATURE: c-term amidation
  MOD_RES (1)..(1): Alpha, Alpha Dimethly Imidiazole Acetic Acid
  MOD_RES (24)..(24): Cys-PEG
XSQGTFTSDYSKYLDEQAAKEFICWLMNT

SEQ ID NO: 520 - protein, 29 aa, Artificial Sequence
  Synthetic peptide
  MISC_FEATURE: c-term amidation
  MOD_RES (1)..(1): Alpha, Alpha Dimethyl Imidiazole Acetic Acid
  MOD_RES (29)..(29): Cys-PEG
XSQGTFTSDYSKYLDEQAAKEFIAWLMNC

SEQ ID NO: 521 - protein, 39 aa, Artificial Sequence; identical to SEQ ID NO: 36
  Synthetic peptide
  MISC_FEATURE: c-term amidation

SEQ ID NO: 522 - protein, 39 aa, Artificial Sequence
  Synthetic peptide
  MISC_FEATURE: c-term amidation
HSQGTFTSDYSKYLDSRRAQDFVQWLMNGGPSSGAPPPS

SEQ ID NO: 523 - protein, 39 aa, Artificial Sequence
  Synthetic peptide
  MISC_FEATURE: c-term amidation
HSQGTFTSDYSKYLDSRRAQDFVQWLMKGGPSSGAPPPS

SEQ ID NO: 524 - protein, 39 aa, Artificial Sequence
  Synthetic peptide
  MISC_FEATURE: c-term amidation
HSQGTFTSDYSKYLDSRRAQDFVQWLVKGGPSSGAPPPS

SEQ ID NO: 525 - protein, 39 aa, Artificial Sequence
  Synthetic peptide
  MISC_FEATURE: c-term amidation
HSQGTFTSDYSKYLDSRRAQDFVQWLMDGGPSSGAPPPS

SEQ ID NO: 526 - protein, 39 aa, Artificial Sequence
  Synthetic peptide
  MISC_FEATURE: c-term amidation
HSQGTFTSDYSKYLDERRAKDFVQWLMDGGPSSGAPPPS

SEQ ID NO: 527 - protein, 30 aa, Artificial Sequence
  Synthetic peptide
  MISC_FEATURE: c-term amidation
HAEGTFTSDVSSYLEGQAAKEFIAWLVKGG

SEQ ID NO: 528 - protein, 29 aa, Artificial Sequence
  Synthetic peptide
  MISC_FEATURE: c-term amidation
  MOD_RES (2)..(2): Aminoisobutyric acid
  MISC_FEATURE (16)..(20): Lactam ring between side chains at positions 16 and 20
  MOD_RES (24)..(24): Cys-PEG
HXQGTFTSDYSKYLDERRAKDFVCWLMNT

SEQ ID NO: 529 - protein, 39 aa, Artificial Sequence; identical to SEQ ID NO: 513
  Synthetic peptide
  MISC_FEATURE: c-term amidation
  MOD_RES (1)..(1): Alpha, Alpha Dimethyl Imidiazole Acetic Acid
  MOD_RES (24)..(24): Cys-PEG

SEQ ID NO: 530 - protein, 29 aa, Artificial Sequence
  Synthetic peptide
  MISC_FEATURE: c-term amidation
  MOD_RES (1)..(1): Alpha, Alpha Dimethyl Imidiazole Acetic Acid
  MOD_RES (24)..(24): Cys-PEG
XSQGTFTSDYSKYLDERRAKDFVCWLMNT

SEQ ID NO: 531 - protein, 40 aa, Artificial Sequence
  Synthetic peptide
  MISC_FEATURE: c-term amidation
  MOD_RES (2)..(2): Aminoisobutyric acid
  MOD_RES (24)..(24): Cys-PEG
  MOD_RES (40)..(40): Cys-PEG
HXQGTFTSDYSKYLDERRAKEFICWLMNGGPSSGAPPPSC

SEQ ID NO: 532 - protein, 41 aa, Artificial Sequence
  Synthetic peptide
  MISC_FEATURE: c-term amidation
  MOD_RES (2)..(2): Aminoisobutyric acid
  MOD_RES (40)..(40): Cys-PEG
  MOD_RES (41)..(41): Cys-PEG
HXQGTFTSDYSKYLDEQAAKEFIAWLMNGGPSSGAPPPSCC

SEQ ID NO: 533 - protein, 39 aa, Artificial Sequence; identical to SEQ ID NO: 490
  Synthetic peptide
  MOD_RES (2)..(2): Aminoisobutyric acid
  MOD_RES (24)..(24): Cys-PEG
  MISC_FEATURE (24)..(24): c-term amidation

SEQ ID NO: 534 - protein, 29 aa, Artificial Sequence
  Synthetic peptide
  MISC_FEATURE: Chimera 2 AIB2 K10-C8 Cys 24-40K
  MISC_FEATURE: c-term amidation
  MOD_RES (2)..(2): Aminoisobutyric acid
  MOD_RES (10)..(10): Acylated with C8 fatty acid
  MOD_RES (24)..(24): Cys-PEG
HXQGTFTSDKSKYLDEQAAKEFICWLMNT

SEQ ID NO: 535 - protein, 29 aa, Artificial Sequence
  Synthetic peptide
  MISC_FEATURE: Chimera 2 AIB2 K10-C14 Cys 24-40K
  MISC_FEATURE: c-term amidation
  MOD_RES (2)..(2): Aminoisobutyric acid
  MOD_RES (10)..(10): Acylated with C14 fatty acid
  MOD_RES (24)..(24): Cys-PEG
HXQGTFTSDKSKYLDEQAAKEFICWLMNT

SEQ ID NO: 536 - protein, 29 aa, Artificial Sequence
  Synthetic peptide
  MISC_FEATURE: Chimera 2 AIB2 K10-C16 Cys24-40K
  MISC_FEATURE: c-term amidation
  MOD_RES (2)..(2): Aminoisobutyric acid
  MOD_RES (10)..(10): Acylated with C16 fatty acid
  MOD_RES (24)..(24): Cys-PEG
HXQGTFTSDKSKYLDEQAAKEFICWLMNT

SEQ ID NO: 537 - protein, 29 aa, Artificial Sequence
  Synthetic peptide
  MISC_FEATURE: Chimera 2 AIB2 K10-C18 Cys24-40K
  MISC_FEATURE: c-term amidation
  MOD_RES (2)..(2): Aminoisobutyric acid
  MOD_RES (10)..(10): Acylated with C18 fatty acid
  MOD_RES (24)..(24): Cys-PEG
HXQGTFTSDKSKYLDEQAAKEFICWLMNT

SEQ ID NO: 538 - protein, 29 aa, Artificial Sequence
  Synthetic peptide
  MISC_FEATURE: Chimera 2 K10-C18 Cys24-40K
  MISC_FEATURE: c-term amidation
  MOD_RES (10)..(10): Acylated with C18 fatty acid
  MOD_RES (24)..(24): Cys-PEG
HSQGTFTSDKSKYLDEQAAKEFICWLMNT

SEQ ID NO: 539 - protein, 29 aa, Artificial Sequence
  Synthetic peptide
  MISC_FEATURE: Glucagon E16 K20 K10-C18 Cys24-40K
  MOD_RES (10)..(10): Acylated with C18 fatty acid
  MOD_RES (24)..(24): Cys-PEG
HSQGTFTSDKSKYLDERRAKDFVCWLMNT

SEQ ID NO: 540 - protein, 29 aa, Artificial Sequence
  Synthetic peptide
  MISC_FEATURE: Glucagon E16 K20 K10-W-C18
  MISC_FEATURE: c-term amidation
  MOD_RES (10)..(10): Covalently bound to Trp residue comprising a C18 fatty acid
HSQGTFTSDKSKYLDERRAKDFVQWLMNT

SEQ ID NO: 541 - protein, 29 aa, Artificial Sequence
  Synthetic peptide
  MISC_FEATURE: Glucagon E16 K20 K10-W-C16 Cys24-40K
  MOD_RES (10)..(10): Covalently bound to Trp residue comprising a C16 fatty acid
  MOD_RES (24)..(24): Cys-PEG
HSQGTFTSDKSKYLDERRAKDFVCWLMNT

SEQ ID NO: 542 - protein, 29 aa, Artificial Sequence
  Synthetic peptide
  MISC_FEATURE: Glucagon E16 K20 K10-C16
  MISC_FEATURE: c-term amidation
  MOD_RES (10)..(10): Covalently bound to C16 fatty acid
HSQGTFTSDKSKYLDERRAKDFVQWLMNT

SEQ ID NO: 543 - protein, 29 aa, Artificial Sequence
  Synthetic peptide
  MISC_FEATURE: Glucagon E16 K20 K10-C16
  MISC_FEATURE: c-term amidation
  MOD_RES (10)..(10): Covalently bound to Trp residue comprising a C16 fatty acid
HSQGTFTSDKSKYLDERRAKDFVQWLMNT

SEQ ID NO: 544 - protein, 29 aa, Artificial Sequence
  Synthetic peptide
  MISC_FEATURE: Glucagon E16 K20 K10-C18
  MISC_FEATURE: c-term amidation
  MOD_RES (10)..(10): Covalently bound to C18 fatty acid
HSQGTFTSDKSKYLDERRAKDFVQWLMNT

SEQ ID NO: 545 - protein, 29 aa, Artificial Sequence
  Synthetic peptide
  MISC_FEATURE: Glucagon E16 K20
  MISC_FEATURE: c-term amidation
HSQGTFTSDYSKYLDERRAKDFVQWLMNT

SEQ ID NO: 546 - protein, 29 aa, Artificial Sequence
  Synthetic peptide
  MISC_FEATURE: Glucagon E16 K20 K10-W-C16 Cys 24-40K
  MISC_FEATURE: c-term amidation
  MOD_RES (10)..(10): Covalently bound to Trp residue comprising C16 fatty acid
  MOD_RES (24)..(24): Cys-PEG
HSQGTFTSDKSKYLDERRAKDFVCWLMNT

SEQ ID NO: 547 - protein, 29 aa, Artificial Sequence
  Synthetic peptide
  MISC_FEATURE: Glucagon E16 K20 K10-C18 Cys24-40K
  MISC_FEATURE: c-term amidation
  MOD_RES (10)..(10): Covalently bound to C18 fatty acid
  MOD_RES (24)..(24): Cys-PEG
HSQGTFTSDKSKYLDERRAKDFVCWLMNT

SEQ ID NO: 548 - protein, 29 aa, Artificial Sequence
  Synthetic peptide
  MISC_FEATURE: Glucagon E16 K20 K10-C18 Cys24-40K
  MISC_FEATURE: c-term amidation
  MOD_RES (10)..(10): Covalently bound to Trp residue comprising a C18 fatty acid
  MOD_RES (24)..(24): Cys-PEG
HSQGTFTSDKSKYLDERRAKDFVCWLMNT

SEQ ID NO: 549 - protein, 29 aa, Artificial Sequence
  Synthetic peptide
  MISC_FEATURE: Glucagon E16 K20 K10-C16 amide
  MISC_FEATURE: c-term amidation
  MOD_RES (10)..(10): Covalently bound to Glu residue comprising a C16 fatty acid
  MOD_RES (24)..(24): Cys-PEG
HSQGTFTSDKSKYLDERRAQDFVCWLMNT

SEQ ID NO: 550 - protein, 28 aa, Artificial Sequence
  Synthetic peptide
  MISC_FEATURE: Chimera 2 truncated by one amino acid
HSQGTFTSDYSKYLDEQAAKEFIAWLMN

SEQ ID NO: 551 - protein, 27 aa, Artificial Sequence
  Synthetic peptide
  MISC_FEATURE: Chimera 2 truncated by two amino acids
HSQGTFTSDYSKYLDEQAAKEFIAWLM

SEQ ID NO: 552 - protein, 28 aa, Artificial Sequence
  Synthetic peptide
  MISC_FEATURE: aa 1-28, E16 K20 C-terminal amide
  MISC_FEATURE: c-term amidation
HSQGTFTSDYSKYLDERRAKDFVQWLMN

SEQ ID NO: 553 - protein, 27 aa, Artificial Sequence
  Synthetic peptide
  MISC_FEATURE: aa 1-27 E16 K20 C-terminal amide
  MISC_FEATURE: c-term amidation
HSQGTFTSDYSKYLDERRAKDFVQWKM

SEQ ID NO: 554 - protein, 29 aa, Artificial Sequence
  Synthetic peptide
  MISC_FEATURE: c-term amidation
  MOD_RES (27)..(27): Norleucine
HSEGTFTSDYSKYLDEQAAKEFIAWLXNT

SEQ ID NO: 555 - protein, 39 aa, Artificial Sequence
  Synthetic peptide
  MISC_FEATURE (16)..(20): Lactam bridging side chains at positions 16 and 20
YSQGTFTSDYSKYLDEQAAKEFVNWLMNGGPSSGAPPPS

SEQ ID NO: 556 - protein, 29 aa, Artificial Sequence
  Synthetic peptide
  MISC_FEATURE: Chimera 2 with AIB at 16
  MISC_FEATURE: c-term amidation
  MOD_RES (16)..(16): Aminoisobutyric acid
HSQGTFTSDYSKYLDXQAAKEFIAWLMNT

SEQ ID NO: 557 - protein, 29 aa, Artificial Sequence
  Synthetic peptide
  MISC_FEATURE: c-term amidation
  MOD_RES (2)..(2): Aminoisobutyric acid
  MOD_RES (16)..(16): Aminoisobutyric acid
HXQGTFTSDYSKYLDXRRAQDFVQWLMNT

SEQ ID NO: 558 - protein, 29 aa, Artificial Sequence
  Synthetic peptide
  MISC_FEATURE: c-term amidation
  MOD_RES (2)..(2): Aminoisobutyric acid
  MISC_FEATURE (10)..(10): Covalently bound to Trp residue comprising a C16 fatty acid
  MOD_RES (16)..(16): Aminoisobutyric acid
  MOD_RES (24)..(24): Cys-PEG
HXQGTFTSDKSKYLDXRRAQDFVCWLMNT

SEQ ID NO: 559 - protein, 29 aa, Artificial Sequence
  Synthetic peptide
  MISC_FEATURE: c-term amidation
  MOD_RES (2)..(2): Aminoisobutric Acid
  MISC_FEATURE (10)..(10): Covalently bound to Trp residue comprising a C16 fatty acid
  MOD_RES (16)..(16): Aminoisobutric Acid
HXQGTFTSDKSKYLDXRRAQDFVCWLMNT

SEQ ID NO: 560 - protein, 29 aa, Artificial Sequence
  Synthetic peptide
  MISC_FEATURE: c-term amidation
  MOD_RES (2)..(2): Aminoisobutyric acid
  MISC_FEATURE (10)..(10): Covalently bound to Trp residue comprising a C16 fatty acid
  MOD_RES (16)..(16): Aminoisobutyric acid
  MOD_RES (20)..(20): Aminoisobutyric acid
  MOD_RES (24)..(24): Cys-PEG
HXQGTFTSDKSKYLDXRRAXDFVCWLMNT

SEQ ID NO: 561 - protein, 29 aa, Artificial Sequence
  Synthetic peptide
  MISC_FEATURE: c-term amidation
  MOD_RES (2)..(2): Aminoisobutyric acid
  MISC_FEATURE (10)..(10): Covalently bound to Trp residue comprising a C16 fatty acid
  MOD_RES (16)..(16): Aminoisobutyric acid
  MOD_RES (20)..(20): Aminoisobutyric acid
HXQGTFTSDKSKYLDXRRAXDFVCWLMNT

SEQ ID NO: 562 - protein, 29 aa, Artificial Sequence
  Synthetic peptide
  MISC_FEATURE: c-term amidation
  MOD_RES (2)..(2): Aminoisobutyric acid
  MOD_RES (16)..(16): Aminoisobutyric acid
HXQGTFTSDKSKYLDXRRAQDFVQWLMNT

SEQ ID NO: 563 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Acylated with a C16 fatty acyl group
  MOD_RES (16)..(16): Aminoisobutyric Acid
HXQGTFTSDKSKYLDXRRAQDFVQWLMNT

SEQ ID NO: 564 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Acylated with a C16 fatty acyl group via Ala-Ala spacer
  MOD_RES (16)..(16): Aminoisobutyric Acid
HXQGTFTSDKSKYLDXRRAQDFVQWLMNT

SEQ ID NO: 565 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via gamma-Glu-gamma-Glu spacer
  MOD_RES (16)..(16): Aminoisobutryic Acid
HXQGTFTSDKSKYLDXRRAQDFVQWLMNT

SEQ ID NO: 566 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via beta-Ala-beta-Ala spacer
  MOD_RES (16)..(16): Aminoisobutryic Acid
HXQGTFTSDKSKYLDXRRAQDFVQWLMNT

SEQ ID NO: 567 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via 6-aminohexanoic acid spacer
  MOD_RES (16)..(16): Aminoisobutryic Acid
HXQGTFTSDKSKYLDXRRAQDFVQWLMNT

SEQ ID NO: 568 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via Leu-Leu spacer
  MOD_RES (16)..(16): Aminoisobutryic Acid
HXQGTFTSDKSKYLDXRRAQDFVQWLMNT

SEQ ID NO: 569 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via Pro-Pro spacer
  MOD_RES (16)..(16): Aminoisobutryic Acid
HXQGTFTSDKSKYLDXRRAQDFVQWLMNT

SEQ ID NO: 570 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Acylated with a C14 fatty acyl group
  MOD_RES (16)..(16): Aminoisobutyric Acid
  MOD_RES (24)..(24): Pegylated
HXQGTFTSDKSKYLDXRRAQDFVCWLMNT

SEQ ID NO: 571 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Acylated with a C14 fatty acyl group via gamma-Glu-gamma-Glu spacer
  MOD_RES (16)..(16): Aminoisobutyric Acid
  MOD_RES (24)..(24): Pegylated
HXQGTFTSDKSKYLDXRRAQDFVCWLMNT

SEQ ID NO: 572 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C14 fatty acyl group via gamma-Glu-gamma-Glu spacer
  MOD_RES (16)..(16): Aminoisobutryic Acid
HXQGTFTSDKSKYLDXRRAQDFVQWLMNT

SEQ ID NO: 573 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C14 fatty acyl group via Ala-Ala spacer
  MOD_RES (16)..(16): Aminoisobutryic Acid
  MOD_RES (24)..(24): Pegylated
HXQGTFTSDKSKYLDXRRAQDFVCWLMNT

SEQ ID NO: 574 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C14 fatty acyl group via Ala-Ala spacer
  MOD_RES (16)..(16): Aminoisobutryic Acid
HXQGTFTSDKSKYLDXRRAQDFVQWLMNT

SEQ ID NO: 575 - protein, 29 aa, Artificial Sequence
  Synthetic peptide
  MISC_FEATURE: c-term amidation
  MOD_RES (2)..(2): Aminoisobutryic acid
  MOD_RES (10)..(10): Acylated with a C16 fatty acyl group via Ala-Ala spacer
  MOD_RES (16)..(16): Aminoisobutryic acid
  MOD_RES (24)..(24): Pegylated
HXQGTFTSDKSKYLDXRRAQDFVCWLMNT

SEQ ID NO: 576 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via gamma-Glu-gamma-Glu spacer
  MOD_RES (16)..(16): Aminoisobutryic Acid
  MOD_RES (24)..(24): Pegylated
HXQGTFTSDKSKYLDXRRAQDFVCWLMNT

SEQ ID NO: 577 - protein, 29 aa, Artificial Sequence
  Synthetic peptide
  MISC_FEATURE: c-term amidation
  MOD_RES (10)..(10): Acylated with a C16 fatty acyl group
HSQGTFTSDKSKYLDSRRAQDFVQWLMNT

SEQ ID NO: 578 - protein, 29 aa, Artificial Sequence
  Synthetic peptide
  MISC_FEATURE: c-term amidation
  MOD_RES (10)..(10): Acylated with a C16 fatty acyl group via gamma-Glu-gamma-Glu spacer
HSQGTFTSDKSKYLDSRRAQDFVQWLMNT

SEQ ID NO: 579 - protein, 29 aa, Artificial Sequence
  Synthetic peptide
  MISC_FEATURE: AA-C16 Glucagon Amide
  MISC_FEATURE: c-term amidation
  MOD_RES (10)..(10): Acylated with a C16 fatty acyl group via Ala-Ala spacer
HSQGTFTSDKSKYLDSRRAQDFVQWLMNT

SEQ ID NO: 580 - protein, 29 aa, Artificial Sequence
  Synthetic peptide
  MISC_FEATURE: Chimera 2, AIB2, Lys10, Cys24-PEG
  MISC_FEATURE: c-term amidation
  MOD_RES (2)..(2): Aminoisobutryic Acid
  MOD_RES (24)..(24): Pegylated
HXQGTFTSDKSKYLDEQAAKEFICWLMNT

SEQ ID NO: 581 - protein, 30 aa, Artificial Sequence
  Synthetic peptide
  MISC_FEATURE: Peptide dS2E16K20K30-C14 Gluc Amide
  MISC_FEATURE: c-term amidation
  MOD_RES (2)..(2): Xaa is d-Ser
  MOD_RES (30)..(30): Acylated with a C14 fatty acyl group
HXQGTFTSDYSKYLDERRAKDFVQWLMNTK

SEQ ID NO: 582 - protein, 29 aa, Artificial Sequence
  Synthetic peptide
  MISC_FEATURE: Peptide dS2K10(C14)E16K20-Gluc Amide
  MISC_FEATURE: c-term amidation
  MOD_RES (2)..(2): Xaa is d-Ser
  MOD_RES (10)..(10): Acylated with a C14 fatty acyl group
HXQGTFTSDKSKYLDERRAKDFVQWLMNT

SEQ ID NO: 583 - protein, 30 aa, Artificial Sequence; identical to SEQ ID NO: 581
  Synthetic peptide
  MISC_FEATURE: Peptide dS2E16K20K30-C16 Gluc Amide
  MISC_FEATURE: c-term amidation
  MOD_RES (2)..(2): Xaa is d-Ser
  MOD_RES (30)..(30): Acylated with a C16 fatty acyl group

SEQ ID NO: 584 - protein, 29 aa, Artificial Sequence
  Synthetic peptide
  MISC_FEATURE: Peptide dS2K10(C16)E16K20-Gluc Amide
  MISC_FEATURE: c-term amidation
  MOD_RES (2)..(2): Xaa is d-Ser
  MOD_RES (10)..(10): Acylated with a C16 fatty acyl group
HXQGTFTSDKSKYLDERRAKDFVQWLMNT

SEQ ID NO: 585 - protein, 29 aa, Artificial Sequence
  Synthetic peptide
  MISC_FEATURE: Peptide Chimera 2-AIB2-K10-acylated
  MISC_FEATURE: c-term amidation
  MOD_RES (2)..(2): Aminoisobutryic Acid
  MOD_RES (10)..(10): Acylated with a C18 fatty acyl group
  MOD_RES (24)..(24): Pegylated
HXQGTFTSDKSKYLDEQAAKEFICWLMNT

SEQ ID NO: 586 - protein, 30 aa, Artificial Sequence
  Synthetic peptide
  MISC_FEATURE: Peptide Chimera 2-AIB2-K30-acylated
  MISC_FEATURE: c-term amidation
  MOD_RES (2)..(2): Aminoisobutryic Acid
  MOD_RES (24)..(24): Pegylated
  MOD_RES (30)..(30): Acylated with a C18 fatty acyl group
HXQGTFTSDYSKYLDEQAAKEFICWLMNTK

SEQ ID NO: 587 - protein, 29 aa, Artificial Sequence
  Synthetic peptide
  MISC_FEATURE: c-term amidation
  MOD_RES (1)..(1): DMIA
XSQGTFTSDYSKYLDERRAKDFVCWLMNT

SEQ ID NO: 588 - protein, 29 aa, Artificial Sequence
  Synthetic peptide
  MISC_FEATURE: c-term amidation
  MOD_RES (1)..(1): DMIA
  MOD_RES (16)..(20): Lactam ring between side chains of amino acids at positions 16 and 20
XSQGTFTSDYSKYLDERRAKDFVCWLMNT

SEQ ID NO: 589 - protein, 29 aa, Artificial Sequence
  Synthetic peptide
  MISC_FEATURE: c-term amidation
  MOD_RES (2)..(2): Aminoisobutryic Acid
HXEGTFTSDYSKYLDEQAAKEFICWLMNT

SEQ ID NO: 590 - protein, 29 aa, Artificial Sequence
  Synthetic peptide
  MISC_FEATURE: c-term amidation
  MOD_RES (2)..(2): Aminoisobutryic Acid
  MOD_RES (24)..(24): Pegylated
HXEGTFTSDYSKYLDEQAAKEFICWLMNT

SEQ ID NO: 591 - protein, 29 aa, Artificial Sequence
  Synthetic peptide
  MOD_RES (3)..(3): Xaa is a Glutamine analog
  MOD_RES (27)..(27): Xaa is Norleucine
HSXGTFTSDYSKYLDTRRAAEFVAWLXDE

SEQ ID NO: 592 - protein, 29 aa, Artificial Sequence
  Synthetic peptide
  MOD_RES (3)..(3): Xaa is a Glutamine analog
  MOD_RES (16)..(16): Xaa is Aib
HSXGTFTSDYSKYLDXRRAADFVAWLMDE

SEQ ID NO: 593 - protein, 29 aa, Artificial Sequence
  Synthetic peptide
  MOD_RES (27)..(27): Xaa is Norleucine
HSQGTFTSDYSKYLDTRRAAEFVAWLXDE

SEQ ID NO: 594 - protein, 29 aa, Artificial Sequence
  Synthetic peptide
  MOD_RES (3)..(3): Xaa is Acetamidomethyl-cysteine
  MOD_RES (27)..(27): Xaa is Norleucine
HSXGTFTSDYSKYLDTRRAAEFVAWLXDE

SEQ ID NO: 595 - protein, 29 aa, Artificial Sequence
  Synthetic peptide
  MOD_RES (3)..(3): Xaa is Acetyldiaminobutanoic acid
  MOD_RES (27)..(27): Xaa is Norleucine
HSXGTFTSDYSKYLDTRRAAEFVAWLXDE

SEQ ID NO: 596 - protein, 29 aa, Artificial Sequence
  Synthetic peptide
  MOD_RES (3)..(3): Xaa is carbamoyldiaminopropanoic acid
  MOD_RES (27)..(27): Xaa is Norleucine
HSXGTFTSDYSKYLDTRRAAEFVAWLXDE

SEQ ID NO: 597 - protein, 29 aa, Artificial Sequence
  Synthetic peptide
  MOD_RES (3)..(3): Xaa is Methylglutamine
  MOD_RES (27)..(27): Xaa is Norleucine
HSXGTFTSDYSKYLDTRRAAEFVAWLXDE

SEQ ID NO: 598 - protein, 29 aa, Artificial Sequence
  Synthetic peptide
  MOD_RES (3)..(3): Xaa is Methionine sulfoxide
  MOD_RES (27)..(27): Xaa is Norleucine
HSXGTFTSDYSKYLDTRRAAEFVAWLXDE

SEQ ID NO: 599 - protein, 29 aa, Artificial Sequence
  Synthetic peptide
  MOD_RES (3)..(3): Acetylornithine
  MOD_RES (27)..(27): Xaa is Norleucine
HSXGTFTSDYSKYLDTRRAAEFVAWLXDE

SEQ ID NO: 600 - protein, 29 aa, Artificial Sequence
  Synthetic peptide
  MOD_RES (16)..(16): Xaa is Aminoisobutryic Acid
HSQGTFTSDYSKYLDXRRAADFVAWLMDE

SEQ ID NO: 601 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutyric Acid
HSXGTFTSDYSKYLDXRRAADFVAWLMDE

SEQ ID NO: 602 - protein, 29 aa, Artificial Sequence
  Synthetic peptide
  MOD_RES (3)..(3): Xaa is Methylglutamine
  MOD_RES (16)..(16): Xaa is Aminoisobutyric Acid
HSXGTFTSDYSKYLDXRRAADFVAWLMDE

SEQ ID NO: 603 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryic Acid
HSXGTFTSDYSKYLDXRRAADFVAWLLDE

SEQ ID NO: 604 - protein, 39 aa, Artificial Sequence
  Synthetic peptide
  MISC_FEATURE: c-term amidation
  MOD_RES (3)..(3): Xaa is Acetyldiaminobutanoic acid
  MOD_RES (16)..(16): Xaa is Aminoisobutyric Acid
HSXGTFTSDYSKYLDXRRAADFVAWLLDTGPSSGAPPPS

SEQ ID NO: 605 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryic Acid
HSXGTFTSDYSKYLDXRRASDFVSWLLDE

SEQ ID NO: 606 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryic Acid
HSXGTFTSDYSKYLDXRRATDFVTWLLDE

SEQ ID NO: 607 - protein, 29 aa, Artificial Sequence
  Synthetic peptide
  MISC_FEATURE: c-term amidation
  MOD_RES (1)..(1): Xaa is Dmia
  MOD_RES (10)..(10): Covalently bound to a C14 fatty acyl group
  MOD_RES (16)..(20): Lactam ring between side chains of amino acids at positions 16 and 20
XSQGTFTSDKSKYLDERRAKDFVQWLMNT

SEQ ID NO: 608 - protein, 29 aa, Artificial Sequence
  Synthetic peptide
  MISC_FEATURE: c-term amidation
  MOD_RES (1)..(1): DMIA
  MOD_RES (10)..(10): Covalently bound to C16 fatty acyl group
  MOD_RES (16)..(20): Lactam ring between side chains of amino acids at positions 16 and 20
XSQGTFTSDKSKYLDERRAKDFVQWLMNT

SEQ ID NO: 609 - protein, 29 aa, Artificial Sequence
  Synthetic peptide
  MISC_FEATURE: c-term amidation
  MOD_RES (1)..(1): DMIA
  MOD_RES (10)..(10): Covalently bound to C18 fatty acyl group
  MOD_RES (16)..(20): Lactam ring between side chains of amino acids at positions 16 and 20
XSQGTFTSDKSKYLDERRAKDFVQWLMNT

SEQ ID NO: 610 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C14 fatty acyl group
  MOD_RES (16)..(16): Aminoisobutryic Acid
HXQGTFTSDKSKYLDXRRAQDFVQWLMNT

SEQ ID NO: 611 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C16 fatty acyl group
  MOD_RES (16)..(16): Aminoisobutryic Acid
HXQGTFTSDKSKYLDXRRAQDFVQWLMNT

SEQ ID NO: 612 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C18 fatty acyl group
  MOD_RES (16)..(16): Aminoisobutryic Acid
HXQGTFTSDKSKYLDXRRAQDFVQWLMNT

SEQ ID NO: 613 - protein, 29 aa, Artificial Sequence
  Synthetic peptide
  MISC_FEATURE: c-term amidation
  MOD_RES (2)..(2): Xaa is d-Ser
  MOD_RES (10)..(10): Covalently bound to C14 fatty acyl group
HXQGTFTSDKSKYLDERRAKDFVQWLMNT

SEQ ID NO: 614 - protein, 29 aa, Artificial Sequence
  Synthetic peptide
  MISC_FEATURE: c-term amidation
  MOD_RES (2)..(2): Xaa is d-Ser
  MOD_RES (10)..(10): Covalently bound to C16 fatty acyl group
HXQGTFTSDKSKYLDERRAKDFVQWLMNT

SEQ ID NO: 615 - protein, 29 aa, Artificial Sequence
  Synthetic peptide
  MISC_FEATURE: c-term amidation
  MOD_RES (2)..(2): Xaa is d-Ser
  MOD_RES (10)..(10): Covalently bound to a C18 fatty acyl group
HXQGTFTSDKSKYLDERRAKDFVQWLMNT

SEQ ID NO: 616 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Covalently bound to a C14 fatty acyl group
  MOD_RES (16)..(16): Aminoisobutyric Acid
HXQGTFTSDKSKYLDXRRAQDFVCWLMNT

SEQ ID NO: 617 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C14 fatty acyl group via gamma-Glu-gamma-Glu spacer
  MOD_RES (16)..(16): Aminoisobutryic Acid
HXQGTFTSDKSKYLDXRRAQDFVCWLMNT

SEQ ID NO: 618 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C14 fatty acyl group via Ala-Ala spacer
  MOD_RES (16)..(16): Aminoisobutryic Acid
HXQGTFTSDKSKYLDXRRAQDFVCWLMNT

SEQ ID NO: 619 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Covalently bound to C16 fatty acyl group via di peptide spacer
  MOD_RES (16)..(16): Aminoisobutyric Acid
HXQGTFTSDKSKYLDXRRAQDFVCWLMNT

SEQ ID NO: 620 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Covelently bound to C16 fatty acyl group via Ala-Ala spacer
  MOD_RES (16)..(16): Aminoisobutyric Acid
HXQGTFTSDKSKYLDXRRAQDFVCWLMNT

SEQ ID NO: 621 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Covalently bound to C16 fatty acyl group
  MOD_RES (16)..(16): Aminoisobutyric Acid
HXQGTFTSDKSKYLDXRRAQDFVCWLMNT

SEQ ID NO: 622 - protein, 30 aa, Artificial Sequence
  Synthetic peptide
  MISC_FEATURE: c-term amidation
  MOD_RES (2)..(2): Aminoisobutyric Acid
  MOD_RES (10)..(10): Covalently bound to C16 fatty acyl group
  MOD_RES (16)..(16): Aminoisobutyric Acid
HXQGTFTSDKSKYLDXRRAQDFVCWLMNTK

SEQ ID NO: 623 - protein, 29 aa, Artificial Sequence
  Synthetic peptide
  MISC_FEATURE: beta-Ala-beta-Ala - C16 Glucagon Amide
  MISC_FEATURE: c-term amidation
  MISC_FEATURE (10)..(10): Acylated with a C16 fatty acyl group via beta-Ala-beta-Ala spacer
HSQGTFTSDKSKYLDSRRAQDFVQWLMNT

SEQ ID NO: 624 - protein, 29 aa, Artificial Sequence
  Synthetic peptide
  MISC_FEATURE: Chimera-2 Aib2C24Mal40KPEG
  MOD_RES (2)..(2): Xaa is Aib
  MOD_RES (24)..(24): Covalently bound to 40kDa PEG via thioether made by reaction of peptide with a maleimide-activated PEG
  MOD_RES (29)..(29): AMIDATION
HXQGTFTSDYSKYLDEQAAKEFICWLMNT

SEQ ID NO: 625 - protein, 29 aa, Artificial Sequence
  Synthetic peptide
  MISC_FEATURE: Chimera-2 Aib2E16K20lactamC24Mal40KPEG
  MOD_RES (2)..(2): Xaa is Aib
  MISC_FEATURE (16)..(20): Lactam ring between side chains of the amino acids at positions 16 and 20
  MOD_RES (24)..(24): Covalently bound to 40kDa PEG via thioether made by reaction of peptide with a maleimide-activated PEG
  MOD_RES (29)..(29): AMIDATION
HXQGTFTSDYSKYLDEQAAKEFICWLMNT

SEQ ID NO: 626 - protein, 29 aa, Artificial Sequence
  Synthetic peptide
  MISC_FEATURE: Glucagon Aib2E16K20lactamC24amideMal40KPEG
  MOD_RES (2)..(2): Xaa is Aib
  MISC_FEATURE (16)..(20): Lactam ring between side chains of amino acids at positions 16 and 20
  MOD_RES (24)..(24): Covalently bound to 40kDa PEG via thioether made by reaction of peptide with a maleimide-activated PEG
  MOD_RES (29)..(29): AMIDATION
HXQGTFTSDYSKYLDERRAKDFVCWLMNT

SEQ ID NO: 627 - skipped

SEQ ID NO: 628 - protein, 29 aa, Artificial Sequence
  Synthetic peptide
  MISC_FEATURE: Glucagon Dmia1E16K20lactamC24Mal40KPEG
  MOD_RES (1)..(1): Xaa is Dmia
  MISC_FEATURE (16)..(20): Lactam ring between side chains of amino acids at positions 16 and 20
  MOD_RES (24)..(24): Covalently bound to 40kDa PEG via thioether made by reaction of peptide with a maleimide-activated PEG
  MOD_RES (29)..(29): AMIDATION
XSQGTFTSDYSKYLDERRAKDFVCWLMNT

SEQ ID NO: 629 - protein, 29 aa, Artificial Sequence
  Synthetic peptide
  MISC_FEATURE: Glucagon Dmia1E16K20lactamC24Mal40KPEG
  MOD_RES (1)..(1): Xaa is Dmia
  MISC_FEATURE (16)..(20): Lactam ring between side chains of amino acids at positions 16 and 20
  MISC_FEATURE (24)..(24): Covalently bound to 40kDa PEG via thioether made by reaction of peptide with a maleimide-activated PEG
XSQGTFTSDYSKYLDERRAKDFVCWLMNT

SEQ ID NO: 630 - protein, 29 aa, Artificial Sequence
  Synthetic peptide
  MISC_FEATURE: Glucagon Dmia1E16K20lactamC24thioether40KPEG
  MOD_RES (1)..(1): Xaa is Dmia
  MISC_FEATURE (16)..(20): Lactam ring between side chains of amino acids at position 16 and 20
  MOD_RES (24)..(24): Covalently bound to 40kDa PEG via thioether made by reaction of peptide with haloacetyl-activated PEG
  MOD_RES (29)..(29): AMIDATION
XSQGTFTSDYSKYLDERRAKDFVCWLMNT

SEQ ID NO: 631 - protein, 29 aa, Artificial Sequence
  Synthetic peptide
  MISC_FEATURE: Chimera2 Aib2E3C24-Thioether40K PEG(NOF)
  MOD_RES (2)..(2): Xaa is Aib
  MOD_RES (24)..(24): Covalently bound to 40kDa PEG via thioether made by reaction of peptide with haloacetyl-activated PEG
  MOD_RES (29)..(29): AMIDATION
HXEGTFTSDYSKYLDEQAAKEFICWLMNT

SEQ ID NO: 632 - protein, 29 aa, Artificial Sequence
  Synthetic peptide
  MOD_RES (1)..(1): Xaa is Dmia
  MOD_RES (24)..(24): Covalently bound to 40kDa PEG
  MOD_RES (29)..(29): AMIDATION
XSEGTFTSDYSKYLEERRAKDFVCWLMNT

SEQ ID NO: 633 - protein, 29 aa, Artificial Sequence
  Synthetic peptide
  MISC_FEATURE: Glucagon Aib2Aib16C24K10(rErE-C16) C24PEG40K amide
  MOD_RES (2)..(2): Xaa is Aib
  MOD_RES (10)..(10): Covalently bound to C14 fatty acyl group via gamma-Glu-gamma-Glu spacer
  MOD_RES (16)..(16): Xaa is Aib
  MOD_RES (24)..(24): Covalently bound to 40kDa PEG via thioether made by reaction of peptide with haloacetyl-activated PEG
  MOD_RES (29)..(29): AMIDATION
HXQGTFTSDKSKYLDXRRAQDFVCWLMNT

SEQ ID NO: 634 - protein, 29 aa, Artificial Sequence
  Synthetic peptide
  MISC_FEATURE: Glucagon Aib2Aib16K10(AA-C14)C24PEG40K TE amide
  MOD_RES (2)..(2): Xaa is Aib
  MOD_RES (10)..(10): Covalently bound to C14 fatty acyl group via Ala-Ala spacer
  MOD_RES (16)..(16): Xaa is Aib
  MOD_RES (24)..(24): Covalently bound to 40kDa PEG via thioether made by reaction of peptide with haloacetyl-activated PEG
  MOD_RES (29)..(29): AMIDATION
HXQGTFTSDKSKYLDXRRAQDFVCWLMNT

SEQ ID NO: 635 - protein, 29 aa, Artificial Sequence
  Synthetic peptide
  MISC_FEATURE: Glucagon Aib2Aib16K10(AA-C16) amide
  MOD_RES (2)..(2): Xaa is Aib
  MOD_RES (10)..(10): Covalently bound to C16 fatty acyl group via Ala-Ala spacer
  MOD_RES (16)..(16): Xaa is Aib
  MOD_RES (29)..(29): AMIDATION
HXQGTFTSDKSKYLDXRRAQDFVQWLMNT

SEQ ID NO: 636 - protein, 29 aa, Artificial Sequence
  Synthetic peptide
  MISC_FEATURE: Glucagon Aib2Aib16K10(rErE-C16) amide
  MOD_RES (2)..(2): Xaa is Aib
  MOD_RES (10)..(10): Covalently bound to C16 fatty acyl group via gamma-Glu-gamma-Glu spacer
  MOD_RES (16)..(16): Xaa is Aib
  MOD_RES (29)..(29): AMIDATION
HXQGTFTSDKSKYLDXRRAQDFVQWLMNT

SEQ ID NO: 637 - protein, 29 aa, Artificial Sequence
  Synthetic peptide
  MOD_RES (2)..(2): Xaa is Aib
  MOD_RES (16)..(16): Xaa is Aib
  MOD_RES (29)..(29): AMIDATION
HXQGTFTSDYSKYLDXRRAQDFVQWLMNT

SEQ ID NO: 638 - DNA, 20 bp, Artificial Sequence
  Synthetic primer
caaggtccagggaggttgtg

SEQ ID NO: 639 - DNA, 24 bp, Artificial Sequence
  Synthetic primer
ccaaaggtaagctgtccataagga

SEQ ID NO: 640 - DNA, 22 bp, Artificial Sequence
  Synthetic primer
ctctcccaagagtcacatgtcc

SEQ ID NO: 641 - DNA, 22 bp, Artificial Sequence
  Synthetic primer
caataactcggtcccctacaac

SEQ ID NO: 642 - protein, 29 aa, Artificial Sequence
  Synthetic peptide
HSQGTFTSDYSKYLDSRRAQDFVQWLMDT

SEQ ID NO: 643 - protein, 29 aa, Artificial Sequence
  Synthetic peptide
  MISC_FEATURE: c-term amidation
  MOD_RES (2)..(2): Xaa is d-Ser
  MOD_RES (10)..(10): Acylated with a C16 fatty acyl group via gamma-Glu spacer
HXQGTFTSDKSKYLDEQAAKEFIAWLMNT

SEQ ID NO: 644 - protein, 29 aa, Artificial Sequence
  Synthetic peptide
  MISC_FEATURE: c-term amidation
  MOD_RES (2)..(2): Xaa is d-Ser
  MOD_RES (10)..(10): Acylated with a C16 fatty acyl group via gamma-Glu-gamma-Glu spacer
HXQGTFTSDKSKYLDEQAAKEFIAWLMNT

SEQ ID NO: 645 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu spacer
HXQGTFTSDKSKYLDEQAAKEFIAWLMNT

SEQ ID NO: 646 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu-gamma-Glu spacer
HXQGTFTSDKSKYLDEQAAKEFIAWLMNT

SEQ ID NO: 647 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group
HXEGTFTSDKSKYLDEQAAKEFIAWLMNT

SEQ ID NO: 648 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu-gamma-Glu spacer
HXEGTFTSDKSKYLDEQAAKEFIAWLMNT

SEQ ID NO: 649 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu spacer
HXQGTFISDKSKYLDEQAAKEFIAWLMNT

SEQ ID NO: 650 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu-gamma-Glu spacer
HXQGTFISDKSKYLDEQAAKEFIAWLMNT

SEQ ID NO: 651 - protein, 29 aa, Artificial Sequence
  Synthetic peptide
  MISC_FEATURE: c-term amidation
  MOD_RES (1)..(1): Xaa is Dmia
  MOD_RES (10)..(10): Acylated with a C16 fatty acyl group via gamma-Glu spacer
  MISC_FEATURE (16)..(20): Lactam ring between side chains of amino acids at positions 16 and 20
XSQGTFTSDKSKYLDERRAKDFVQWLMNT

SEQ ID NO: 652 - protein, 29 aa, Artificial Sequence
  Synthetic peptide
  MISC_FEATURE: c-term amidation
  MOD_RES (1)..(1): Xaa is Dmia
  MOD_RES (10)..(10): Acylated with a C16 fatty acyl group via gamma-Glu-gamma-Glu spacer
  MISC_FEATURE (16)..(20): Lactam ring between side chains of amino acids at positions 16 and 20
XSQGTFTSDKSKYLDERRAKDFVQWLMNT

SEQ ID NO: 653 - protein, 29 aa, Artificial Sequence
  Synthetic peptide
  MISC_FEATURE: c-term amidation
  MOD_RES (1)..(1): Xaa is Dmia
  MISC_FEATURE (16)..(20): Lactam ring between side chains of amino acids at positions 16 and 20
  MOD_RES (29)..(29): Acylated with a C16 fatty acyl group via gamma-Glu spacer
XSQGTFTSDYSKYLDERRAKDFVQWLMNK

SEQ ID NO: 654 - protein, 29 aa, Artificial Sequence
  Synthetic peptide
  MISC_FEATURE: c-term amidation
  MOD_RES (1)..(1): Xaa is Dmia
  MISC_FEATURE (16)..(20): Lactam ring between side chains of amino acids at positions 16 and 20
  MOD_RES (29)..(29): Acylated with a C16 fatty acyl group via gamma-Glu-gamma-Glu spacer
XSQGTFTSDYSKYLDERRAKDFVQWLMNK

SEQ ID NO: 655 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu-gamma-Glu spacer
  MOD_RES (16)..(16): Xaa is Aib
HXQGTFTSDKSKYLDXRAAQDFVQWLMDT

SEQ ID NO: 656 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via gamma-Glu spacer
  MOD_RES (16)..(16): Xaa is Aib
HXQGTFTSDKSKYLDXRAAQDFVQWLMDT

SEQ ID NO: 657 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via dipeptide spacer
  MOD_RES (16)..(16): Aminoisobutryic Acid
HXQGTFTSDKSKYLDXRRAQDFVQWLMNT

SEQ ID NO: 658 - protein, 29 aa, Artificial Sequence
  Synthetic peptide
  MISC_FEATURE: c-term amidation
  MOD_RES (2)..(2): Aminoisobutyric Acid
  MOD_RES (10)..(10): Acylated with a C14 fatty acyl group via dipeptide spacer
  MOD_RES (16)..(16): Aminoisobutyric Acid
  MOD_RES (24)..(24): Pegylated
HXQGTFTSDKSKYLDXRRAQDFVCWLMNT

SEQ ID NO: 659 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C14 fatty acyl group via dipeptide spacer
  MOD_RES (16)..(16): Aminoisobutryic Acid
HXQGTFTSDKSKYLDXRRAQDFVQWLMNT

SEQ ID NO: 660 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Acylated with a C16 fatty acyl group via dipeptide spacer
  MOD_RES (16)..(16): Aminoisobutryic Acid
  MOD_RES (24)..(24): Pegylated
HXQGTFTSDKSKYLDXRRAQDFVCWLMNT

SEQ ID NO: 661 - protein, 29 aa, Artificial Sequence
  Synthetic peptide
  MISC_FEATURE: c-term amidation
  MOD_RES (10)..(10): Acylated with a C16 fatty acyl group via dipeptide spacer
HSQGTFTSDKSKYLDSRRAQDFVQWLMNT

SEQ ID NO: 662 - protein, 30 aa, Artificial Sequence; identical to SEQ ID NO: 581
  Synthetic peptide
  MISC_FEATURE: Peptide dS2E16K20K30-C14 Gluc Amide
  MISC_FEATURE: c-term amidation
  MOD_RES (2)..(2): D-serine, D-alanine, valine, amino n-butyric acid, glycine, N-methyl serine, aminoisobutyric acid
  MOD_RES (30)..(30): Acylated with a C14 fatty acyl group

SEQ ID NO: 663 - protein, 29 aa, Artificial Sequence
  Synthetic peptide
  MISC_FEATURE: Peptide dS2K10(C14)E16K20-Gluc Amide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Acylated with a C14 fatty acyl group
HXQGTFTSDKSKYLDERRAKDFVQWLMNT

SEQ ID NO: 664 - protein, 30 aa, Artificial Sequence; identical to SEQ ID NO: 581
  Synthetic peptide
  MISC_FEATURE: Peptide dS2E16K20K30-C16 Gluc Amide
  MISC_FEATURE: c-term amidation
  MOD_RES (2)..(2): D-serine, D-alanine, valine, amino n-butyric acid, glycine, N-methyl serine, aminoisobutyric acid
  MOD_RES (30)..(30): Acylated with a C16 fatty acyl group

SEQ ID NO: 665 - protein, 29 aa, Artificial Sequence
  Synthetic peptide
  MISC_FEATURE: Peptide dS2K10(C16)E16K20-Gluc Amide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Acylated with a C16 fatty acyl group
HXQGTFTSDKSKYLDERRAKDFVQWLMNT

SEQ ID NO: 666 - protein, 29 aa, Artificial Sequence
  Synthetic peptide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Covalently bound to C14 fatty acyl group
HXQGTFTSDKSKYLDERRAKDFVQWLMNT

SEQ ID NO: 667 - protein, 29 aa, Artificial Sequence
  Synthetic peptide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Covalently bound to C16 fatty acyl group
HXQGTFTSDKSKYLDERRAKDFVQWLMNT

SEQ ID NO: 668 - protein, 29 aa, Artificial Sequence
  Synthetic peptide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Covalently bound to a C18 fatty acyl group
HXQGTFTSDKSKYLDERRAKDFVQWLMNT

SEQ ID NO: 669 - protein, 29 aa, Artificial Sequence
  Synthetic peptide
  MISC_FEATURE: c-term amidation
  MOD_RES (2)..(2): Aminoisobutryic Acid
  MOD_RES (10)..(10): Covalently bound to C14 fatty acyl group via dipeptide spacer
  MOD_RES (16)..(16): Aminoisobutryic Acid
HXQGTFTSDKSKYLDXRRAQDFVCWLMNT

SEQ ID NO: 670 - protein, 29 aa, Artificial Sequence
  Synthetic peptide
  MISC_FEATURE: Glucagon Aib2Aib16C24K10(rErE-C16) C24PEG40K amide
  MOD_RES (2)..(2): Xaa is Aib
  MOD_RES (10)..(10): Covalently bound to C14 fatty acyl group via dipeptide spacer
  MOD_RES (16)..(16): Xaa is Aib
  MOD_RES (24)..(24): Covalently bound to 40kDa PEG via thioether made by reaction of peptide with haloacetyl-activated PEG
  MOD_RES (29)..(29): AMIDATION
HXQGTFTSDKSKYLDXRRAQDFVCWLMNT

SEQ ID NO: 671 - protein, 29 aa, Artificial Sequence
  Synthetic peptide
  MISC_FEATURE: Glucagon Aib2Aib16K10(rErE-C16) amide
  MOD_RES (2)..(2): Xaa is Aib
  MOD_RES (10)..(10): Covalently bound to C16 fatty acyl group via dipeptide spacer
  MOD_RES (16)..(16): Xaa is Aib
  MOD_RES (29)..(29): AMIDATION
HXQGTFTSDKSKYLDXRRAQDFVQWLMNT

SEQ ID NO: 672 - protein, 29 aa, Artificial Sequence
  Synthetic peptide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Acylated with a C16 fatty acyl group via acidic amino acid spacer
HXQGTFTSDKSKYLDEQAAKEFIAWLMNT

SEQ ID NO: 673 - protein, 29 aa, Artificial Sequence
  Synthetic peptide
  MISC_FEATURE: c-term amidation
  MOD_RES (2)..(2): D-serine, D-alanine, valine, amino n-butyric acid, glycine, N-methyl serine, aminoisobutyric acid
  MOD_RES (10)..(10): Acylated with a C16 fatty acyl group via dipeptide spacer
HXQGTFTSDKSKYLDEQAAKEFIAWLMNT

SEQ ID NO: 674 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via acidic amino acid spacer
HXQGTFTSDKSKYLDEQAAKEFIAWLMNT

SEQ ID NO: 675 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via dipeptide spacer
HXQGTFTSDKSKYLDEQAAKEFIAWLMNT

SEQ ID NO: 676 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via dipeptide spacer
HXEGTFTSDKSKYLDEQAAKEFIAWLMNT

SEQ ID NO: 677 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via acidic amino acid spacer
HXQGTFISDKSKYLDEQAAKEFIAWLMNT

SEQ ID NO: 678 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via dipeptide spacer
HXQGTFISDKSKYLDEQAAKEFIAWLMNT

SEQ ID NO: 679 - protein, 29 aa, Artificial Sequence
  Synthetic peptide
  MISC_FEATURE: c-term amidation
  MOD_RES (1)..(1): Xaa is Dmia
  MOD_RES (10)..(10): Acylated with a C16 fatty acyl group via acidic amino acid spacer
  MISC_FEATURE (16)..(20): Lactam ring between side chains of amino acids at positions 16 and 20
XSQGTFTSDKSKYLDERRAKDFVQWLMNT

SEQ ID NO: 680 - protein, 29 aa, Artificial Sequence
  Synthetic peptide
  MISC_FEATURE: c-term amidation
  MOD_RES (1)..(1): Xaa is Dmia
  MOD_RES (10)..(10): Acylated with a C16 fatty acyl group via dipeptide spacer
  MISC_FEATURE (16)..(20): Lactam ring between side chains of amino acids at positions 16 and 20
XSQGTFTSDKSKYLDERRAKDFVQWLMNT

SEQ ID NO: 681 - protein, 29 aa, Artificial Sequence
  Synthetic peptide
  MISC_FEATURE: c-term amidation
  MOD_RES (1)..(1): Xaa is Dmia
  MISC_FEATURE (16)..(20): Lactam ring between side chains of amino acids at positions 16 and 20
  MOD_RES (29)..(29): Acylated with a C16 fatty acyl group via acidic amino acid spacer
XSQGTFTSDYSKYLDERRAKDFVQWLMNK

SEQ ID NO: 682 - protein, 29 aa, Artificial Sequence
  Synthetic peptide
  MISC_FEATURE: c-term amidation
  MOD_RES (1)..(1): Xaa is Dmia
  MISC_FEATURE (16)..(20): Lactam ring between side chains of amino acids at positions 16 and 20
  MOD_RES (29)..(29): Acylated with a C16 fatty acyl group via dipeptide spacer
XSQGTFTSDYSKYLDERRAKDFVQWLMNK

SEQ ID NO: 683 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via dipeptide spacer
  MOD_RES (16)..(16): Xaa is Aib
HXQGTFTSDKSKYLDXRAAQDFVQWLMDT

SEQ ID NO: 684 - protein, 29 aa, Artificial Sequence
  Synthetic peptide
  MISC_FEATURE: c-term amidation
  MOD_RES (2)..(2): Xaa is Aib
  MOD_RES (10)..(10): Acylated with a C16 fatty acyl group via acidic amino acid spacer
  MOD_RES (16)..(16): Xaa is Aib
HXQGTFTSDKSKYLDXRAAQDFVQWLMDT

SEQ ID NO: 685-700 - skipped (16 entries)

SEQ ID NO: 701 - protein, 29 aa, Homo sapiens
  MOD_RES (29)..(29): C-terminal amidation
HSQGTFTSDYSKYLDSRRAQDPVQWLMNT

SEQ ID NO: 702 - protein, 24 aa, Artificial Sequence
  Glucagon analog
  MOD_RES (1)..(1): N-terminal amino group replaced with hydroxy group
FTSDYSKYLDSRRAQDFVQWLMNT

SEQ ID NO: 703 - protein, 31 aa, Homo sapiens; identical to SEQ ID NO: 50

SEQ ID NO: 704 - protein, 30 aa, Homo sapiens; identical to SEQ ID NO: 52
  MOD_RES (30)..(30): AMIDATION

SEQ ID NO: 705 - protein, 28 aa, Homo sapiens
HGEGTFTSDLSKQMEEAVRLFIEWLKNG

SEQ ID NO: 706 - protein, 37 aa, Homo sapiens
HSQGTFTSDYSKYLDSRRAQDFVQWLMDTKRNRNNIA

SEQ ID NO: 707 - protein, 42 aa, Homo sapiens
YAEGTFISDYSIAMDKIHQQDFVNWLLAQKGKKNDWKHNITQ

SEQ ID NO: 708 - protein, 33 aa, Homo sapiens
HADGSFSDEMNTILDNLAARDFINWLIQTKITD

SEQ ID NO: 709 - protein, 49 aa, Homo sapiens
YLYQWLGAPVPYPDPLEPRREVCELNPDCDELADHIGFQEAYRRFYGPV

SEQ ID NO: 710 - protein, 10 aa, Artificial Sequence
  peptide fragment representing the carboxy terminal 10 amino acids of Exendin-4
GPSSGAPPPS

SEQ ID NO: 711 - protein, 10 aa, Artificial Sequence
  peptide fragment representing the carboxy terminal 10 amino acids of Exendin-4
  MOD_RES (10)..(10): AMIDATION
GPSSGAPPPS

SEQ ID NO: 712 - protein, 11 aa, Artificial Sequence
  peptide fragment representing the carboxy terminal 10 amino acids of Exendin-4
  MOD_RES (11)..(11): Pegylation
GPSSGAPPPSC

SEQ ID NO: 713 - protein, 13 aa, Artificial Sequence
  peptide fragment representing the carboxy terminal 13 amino acids of GIP peptide
KGKKNDWKHNITQ

SEQ ID NO: 714 - protein, 8 aa, Artificial Sequence
  peptide fragment representing the carboxy terminal 8 amino acids of oxyntomodulin
KRNRNNIA

SEQ ID NO: 715 - protein, 6 aa, Artificial Sequence
  Glucagon analogue
  MOD_RES (6)..(6): C-terminal amide
HTRGTF

SEQ ID NO: 716 - protein, 6 aa, Artificial Sequence
  glucagon analogue
  MOD_RES (1)..(1): d-histidine
  MOD_RES (2)..(2): d-threonine
  MOD_RES (3)..(3): d-arginine
  MOD_RES (5)..(5): d-threonine
  MOD_RES (6)..(6): d-phenylalanine
  MOD_RES (6)..(6): C-terminal amidation
XXXGXX

SEQ ID NO: 717 - protein, 30 aa, Artificial Sequence
  glucagon analogue
  MOD_RES (24)..(24): pegylation
HAEGTFTSDVSSYLEGQAAKEFICWLVKGR

SEQ ID NO: 718 - protein, 39 aa, Heloderma suspectum
HGEGTFTSDLSKQMEEEAVRLFIEWLKNGGPSSGAPPPS

SEQ ID NO: 719 - protein, 29 aa, Homo sapiens
YADAIFTNSYRKVLGQLSARKLLQDIMSR

SEQ ID NO: 720 - protein, 28 aa, Homo sapiens
  MOD_RES (28)..(28): AMIDATION
HSDAVFTDNYTRLRKQMAVKKYLNSILN

SEQ ID NO: 721 - protein, 27 aa, Homo sapiens
HSDGIFTDSYSRYRKQMAVKKYLAAVL

SEQ ID NO: 722 - protein, 27 aa, Homo sapiens
  MOD_RES (27)..(27): AMIDATION
HADGVFTSDFSKLLGQLSAKKYLESLM

SEQ ID NO: 723 - protein, 27 aa, Homo sapiens
  MOD_RES (27)..(27): AMIDATION
HSDGTFTSELSRLREGARLQRLLQGLV

SEQ ID NO: 724 - protein, 30 aa, Artificial Sequence
  Synthetic peptide
  MOD_RES (2)..(2): Xaa is AIB
  MOD_RES (24)..(24): Cys residue linked to 40kDa PEG via maleimide
  MOD_RES (30)..(30): C-terminal amidation
HXQGTFTSDYSKYLDEQAAKEFICWLMNTN

SEQ ID NO: 725 - protein, 29 aa, Artificial Sequence
  Synthetic peptide
  MOD_RES (2)..(2): Xaa is AIB
  MISC_FEATURE (24)..(24): Covalently bound to 40K PEG via thioether
  MOD_RES (29)..(29): AMIDATION
HXEGTFTSDYSKYLDEQAAKEFICWLMNT

SEQ ID NO: 726 - protein, 31 aa, Artificial Sequence
  Synthetic peptide
  MOD_RES (1)..(1): d-lysine
  MOD_RES (2)..(2): Sarcosine (N-methyl glycine)
  MOD_RES (4)..(4): Xaa is AIB
  MOD_RES (24)..(24): Covalently bound to 40kDa PEG via thioether
  MOD_RES (31)..(31): AMIDATION
KGHXEGTFTSDYSKYLDEQAAKEFICWLMNT

SEQ ID NO: 727 - protein, 31 aa, Artificial Sequence; identical to SEQ ID NO: 726
  Synthetic peptide
  MOD_RES (1)..(1): d-lysine
  MOD_RES (2)..(2): N-hexyl-glycine
  MOD_RES (4)..(4): Xaa is AIB
  MOD_RES (24)..(24): Covalently bound to 40kDa PEG via maleimide
  MOD_RES (31)..(31): AMIDATION

SEQ ID NO: 728 - protein, 31 aa, Artificial Sequence
  Synthetic peptide
  MOD_RES (1)..(1): d-lysine
  MOD_RES (2)..(2): N-methyl phenylalanine
  MOD_RES (4)..(4): Xaa is AIB
  MOD_RES (24)..(24): Covalently bound to 40kDa PEG via thioether
  MOD_RES (31)..(31): AMIDATION
KFHXEGTFTSDYSKYLDEQAAKEFICWLMNT

SEQ ID NO: 729 - protein, 29 aa, Artificial Sequence
  Synthetic peptide
  MOD_RES (2)..(2): Xaa is AIB
  MOD_RES (24)..(24): Covalently bound to 40 kDa PEG via maleimide
HXEGTFTSDYSKYLDEQAAKEFICWLMNT

SEQ ID NO: 730 - protein, 29 aa, Artificial Sequence
  Synthetic peptide
  MOD_RES (1)..(1): Xaa is DMIA
  MISC_FEATURE (16)..(20): Lactam ring between side chains of amino acids
  MOD_RES (24)..(24): Covalently bound to 40kDa PEG via maleimide
  MOD_RES (29)..(29): C-terminal amidation
XSQGTFTSDKSKYLDERRAKDFVCWLMNT

SEQ ID NO: 731 - protein, 30 aa, Artificial Sequence
  Synthetic peptide
  MOD_RES (30)..(30): C-terminal amidation
HSQGTFTSDYSKYLDEQAAKEFIAWLMNTN

SEQ ID NO: 732 - protein, 8 aa, Artificial Sequence
  Synthetic peptide
  MOD_RES (1)..(1): Xaa is Phe, hydroxyl-Phe, Gly, hydroxyl-Gly, Ala, Cys, Ser, Lys, Glu, dehydro-Val, Pro, d-Pro, AIB, 1-aminocyclohexanecarboxylic acid, 1-aminocyclopropanecarboxylic acid, N-Me-AIB, alpha-alpha-diethyl-Gly, hydroxyl-AIB, or d-Lys
  MOD_RES (2)..(2): Xaa is Pro, d-Pro, N-methyl-Gly, N-hexyl-Gly, Azetidine-2-carboxylic acid, N-methyl-Ala, or N-methyl-Phe
  MOD_RES (3)..(3): Xaa is His, d-His, Ala, or N-methyl-His
  MOD_RES (8)..(8): C-terminal amidation
XXXSRGTF

SEQ ID NO: 733 - protein, 31 aa, Artificial Sequence
  Synthetic peptide
  MOD_RES (1)..(1): d-Lys
  MOD_RES (2)..(2): Xaa is Sar
  MOD_RES (4)..(4): Xaa is AIB
  MOD_RES (26)..(26): Covalently bound to PEG via 40kDa maleimide
KXHXEGTFTSDYSKYLDEQAAKEFICWLMNT

SEQ ID NO: 734 - protein, 32 aa, Artificial Sequence
  Synthetic peptide
  MOD_RES (1)..(1): d-Lys
  MOD_RES (2)..(2): Xaa is Sar
  MOD_RES (4)..(4): Xaa is AIB
  MOD_RES (26)..(26): Cys residue linked to 40kDa PEG via maleimide
  MOD_RES (32)..(32): C-terminal amidation
KXHXQGTFTSDYSKYLDEQAAKEFICWLMNTN

SEQ ID NO: 735 - protein, 31 aa, Artificial Sequence
  Synthetic peptide
  MOD_RES (1)..(1): d-Lys
  MOD_RES (2)..(2): Xaa is Sar
  MOD_RES (3)..(3): Xaa is DMIA
  MISC_FEATURE (18)..(22): Lactam ring between side chains of amino acids
  MOD_RES (26)..(26): Covalently bound to 40kDa PEG via maleimide
  MOD_RES (31)..(31): C-terminal amidation
KXXSQGTFTSDKSKYLDERRAKDFVCWLMNT

SEQ ID NO: 736 - protein, 31 aa, Artificial Sequence; identical to SEQ ID NO: 726
  Synthetic peptide
  MOD_RES (1)..(1): d-Lys
  MOD_RES (2)..(2): N-hexyl-Gly
  MOD_RES (4)..(4): Xaa is AIB
  MISC_FEATURE (26)..(26): Covalently bound to 40K PEG via thioether
  MOD_RES (31)..(31): AMIDATION

SEQ ID NO: 737 - protein, 32 aa, Artificial Sequence
  Synthetic peptide
  MOD_RES (1)..(1): d-Lys
  MOD_RES (2)..(2): N-hexyl-Gly
  MOD_RES (4)..(4): Xaa is AIB
  MOD_RES (26)..(26): Cys residue linked to 40kDa PEG via maleimide
  MOD_RES (32)..(32): C-terminal amidation
KGHXQGTFTSDYSKYLDEQAAKEFICWLMNTN

SEQ ID NO: 738 - protein, 31 aa, Artificial Sequence
  Synthetic peptide
  MOD_RES (1)..(1): d-Lys
  MOD_RES (2)..(2): N-hexyl-Gly
  MOD_RES (3)..(3): Xaa is DMIA
  MISC_FEATURE (18)..(22): Lactam ring between side chains of amino acids
  MOD_RES (26)..(26): Covalently bound to 40kDa PEG via maleimide
  MOD_RES (31)..(31): C-terminal amidation
KGXSQGTFTSDKSKYLDERRAKDFVCWLMNT

SEQ ID NO: 739 - protein, 31 aa, Artificial Sequence; identical to SEQ ID NO: 728
  Synthetic peptide
  MOD_RES (1)..(1): d-Lys
  MOD_RES (2)..(2): N-methyl-Phe
  MOD_RES (4)..(4): Xaa is AIB
  MOD_RES (26)..(26): Covalently bound to 40kDa PEG via maleimide

SEQ ID NO: 740 - protein, 32 aa, Artificial Sequence
  Synthetic peptide
  MOD_RES (1)..(1): d-Lys
  MOD_RES (2)..(2): N-methyl-Phe
  MOD_RES (4)..(4): Xaa is AIB
  MOD_RES (26)..(26): Cys residue linked to 40kDa PEG via maleimide
  MOD_RES (32)..(32): C-terminal amidation
KFHXQGTFTSDYSKYLDEQAAKEFICWLMNTN

SEQ ID NO: 741 - protein, 31 aa, Artificial Sequence
  Synthetic peptide
  MOD_RES (1)..(1): d-Lys
  MOD_RES (2)..(2): N-methyl-Phe
  MOD_RES (3)..(3): Xaa is DMIA
  MISC_FEATURE (18)..(22): Lactam ring between side chains of amino acids
  MOD_RES (26)..(26): Covalently bound to 40kDa PEG via maleimide
  MOD_RES (31)..(31): C-terminal amidation
KFXSQGTFTSDKSKYLDERRAKDFVCWLMNT

SEQ ID NO: 742 - protein, 29 aa, Artificial Sequence
  Synthetic peptide
  MOD_RES (2)..(2): Xaa is AIB
  MOD_RES (24)..(24): Pegylated
  MOD_RES (29)..(29): C-terminal amidation
HXEGTFTSDYSKYLDEQAAKEFICWLMNT

SEQ ID NO: 743 - protein, 29 aa, Artificial Sequence
  Synthetic peptide
  MOD_RES (2)..(2): Xaa is AIB
  MOD_RES (10)..(10): Acylated with fatty acyl group
  MOD_RES (16)..(16): Xaa is AIB
  MOD_RES (29)..(29): C-terminal amidation
HXQGTFTSDKSKYLDXRAAQDFVQWLMDT

SEQ ID NO: 744 - protein, 40 aa, Artificial Sequence
  Synthetic peptide
  MOD_RES (2)..(2): Xaa is AIB
  MOD_RES (40)..(40): C-terminal amidation
HXEGTFTSDVSSYLEEQAAKEFIAWLVKGGPSSGAPPPSK

SEQ ID NO: 745 - protein, 29 aa, Artificial Sequence
  Synthetic peptide
  MOD_RES (1)..(1): Xaa is Dmia
  MISC_FEATURE (16)..(20): Lactam ring between side chains of amino acids at positions 16 and 20
  MOD_RES (24)..(24): Pegylated
  MOD_RES (29)..(29): C-terminal amidation
XSQGTFTSDYSKYLDERRAKDFVCWLMNT

SEQ ID NO: 746 - protein, 29 aa, Artificial Sequence
  Synthetic peptide
  MOD_RES (2)..(2): d-Ser
  MISC_FEATURE (16)..(20): Lactam ring between side chains of amino acids at positions 16 and 20
  MOD_RES (24)..(24): Pegylated
  MOD_RES (29)..(29): C-terminal amidation
HSQGTFTSDYSLYLDERAAKDFVCWLLDT

SEQ ID NO: 747 - protein, 29 aa, Artificial Sequence
  Synthetic peptide
  MOD_RES (2)..(2): Xaa is AIB
  MOD_RES (16)..(16): Xaa is AIB
  MOD_RES (20)..(20): Xaa is AIB
  MOD_RES (24)..(24): Pegylated
  MOD_RES (29)..(29): C-terminal amidation
HXQGTFTSDYSKYLDXKRAXEFVCWLLDT

SEQ ID NO: 748 - protein, 29 aa, Artificial Sequence
  Synthetic peptide
  MOD_RES (2)..(2): Xaa is AIB
  MOD_RES (10)..(10): Acylated with fatty acyl group via dipeptide spacer
  MOD_RES (16)..(16): Xaa is AIB
  MOD_RES (29)..(29): C-terminal amidation
HXQGTFTSDKSKYLDXRAAQDFVQWLMDT

SEQ ID NO: 749 - protein, 29 aa, Artificial Sequence
  Synthetic peptide
  MOD_RES (2)..(2): Xaa is AIB
  MOD_RES (10)..(10): Acylated with fatty acyl group via acidic amino acid spacer
  MOD_RES (16)..(16): Xaa is AIB
  MOD_RES (29)..(29): C-terminal amidation
HXQGTFTSDKSKYLDXRAAQDFVQWLMDT

SEQ ID NO: 750 - protein, 29 aa, Artificial Sequence
  Synthetic peptide
  MOD_RES (2)..(2): d-Ser
  MOD_RES (10)..(10): Acylated with fatty acyl group via dipeptide spacer
  MOD_RES (16)..(16): Xaa is AIB
  MOD_RES (29)..(29): C-terminal amidation
HSQGTFTSDKSKYLDXRAAQDFVQWLMDT

SEQ ID NO: 751 - protein, 29 aa, Artificial Sequence
  Synthetic peptide
  MOD_RES (2)..(2): Xaa is AIB
  MOD_RES (10)..(10): Acylated with fatty acyl group via dipeptide spacer
  MOD_RES (16)..(16): Xaa is AIB
  MOD_RES (29)..(29): C-terminal amidation
HXQGTFTSDKSKYLDXRAAQDFVQWLLDT

SEQ ID NO: 752 - protein, 29 aa, Artificial Sequence
  Synthetic peptide
  MOD_RES (2)..(2): Xaa is AIB
  MOD_RES (10)..(10): Acylated with fatty acyl group via dipeptide spacer
  MOD_RES (29)..(29): C-terminal amidation
HXQGTFTSDKSKYLDERAAQDFVQWLMDT

SEQ ID NO: 753 - protein, 29 aa, Artificial Sequence
  Synthetic peptide
  MOD_RES (2)..(2): Xaa is AIB
  MOD_RES (10)..(10): Acylated with fatty acyl group via dipeptide spacer
  MOD_RES (16)..(16): Xaa is AIB
  MOD_RES (29)..(29): C-terminal amidation
HXQGTFTSDKSKYLEXRAAQDFVQWLMDT

SEQ ID NO: 754 - protein, 29 aa, Artificial Sequence
  Synthetic peptide
  MOD_RES (2)..(2): d-Ser
  MOD_RES (10)..(10): Acylated with fatty acyl group via acidic amino acid spacer
  MOD_RES (29)..(29): C-terminal amidation
HSQGTFTSDKSKYLDERAAQDFVQWLLDT

SEQ ID NO: 755 - protein, 29 aa, Artificial Sequence
  Synthetic peptide
  MOD_RES (2)..(2): Xaa is AIB
  MOD_RES (10)..(10): Acylated with fatty acyl group via acidic amino acid spacer
  MOD_RES (29)..(29): C-terminal amidation
HXQGTFTSDKSKYLDEQAAKEFIAWLLDT

SEQ ID NO: 756 - protein, 40 aa, Artificial Sequence
  Synthetic polypeptide
  MOD_RES (2)..(2): Xaa is Aib
  MOD_RES (20)..(20): Xaa is Aib
  MOD_RES (40)..(40): C-terminal amidation
YXEGTFTSDYSIYLDKQAAXEFVNWLLAGGPSSGAPPPSK

SEQ ID NO: 757 - protein, 39 aa, Artificial Sequence
  Synthetic polypeptide
  MOD_RES (2)..(2): Xaa is Aib
  MOD_RES (20)..(20): Xaa is Aib
  MOD_RES (39)..(39): C-terminal amidation
YXEGTFTSDYSIYLDKQAAXEFVNWLLAGGPSSGAPPPS

SEQ ID NO: 758 - protein, 39 aa, Artificial Sequence
  Synthetic polypeptide
  MOD_RES (2)..(2): Xaa is Aib
  MOD_RES (10)..(10): Acylated with fatty acyl group via dipeptide spacer
  MOD_RES (20)..(20): Xaa is AIB
  MOD_RES (39)..(39): C-terminal amidation
YXEGTFTSDKSIYLDKQAAXEFVNWLLAGGPSSGAPPPS

SEQ ID NO: 759 - protein, 40 aa, Artificial Sequence
  Synthetic polypeptide
  MOD_RES (2)..(2): Xaa is AIB
  MOD_RES (20)..(20): Xaa is AIB
  MOD_RES (24)..(24): Pegylated
  MOD_RES (40)..(40): C-terminal amidation
YXEGTFTSDYSIYLDKQAAXEFVCWLLAGGPSSGAPPPSK

SEQ ID NO: 760 - protein, 40 aa, Artificial Sequence
  Synthetic polypeptide
  MOD_RES (2)..(2): Xaa is AIB
  MOD_RES (20)..(20): Xaa is AIB
  MOD_RES (40)..(40): Pegylated
  MOD_RES (40)..(40): C-terminal amidation
YXEGTFTSDYSIYLDKQAAXEFVNWLLAGGPSSGAPPPSC

SEQ ID NO: 761 - protein, 40 aa, Artificial sequence
  Synthetic polypeptide
  MOD_RES (2)..(2): Xaa is AIB
  MISC_FEATURE (16)..(20): Lactam bridge between side chains of amino acids at positions 16 and 20
  MOD_RES (40)..(40): Pegylated
  MOD_RES (40)..(40): C-terminal amidation
YXEGTFTSDYSIYLDEQAAKEFVNWLLAGGPSSGAPPPSC

SEQ ID NO: 762 - protein, 40 aa, Artificial Sequence; identical to SEQ ID NO: 760
  Synthetic polypeptide
  MOD_RES (2)..(2): Xaa is AIB
  MOD_RES (20)..(20): Xaa is AIB
  MOD_RES (40)..(40): Pegylated
  MOD_RES (40)..(40): C-terminal amidation

SEQ ID NO: 763 - protein, 40 aa, Artificial Sequence; identical to SEQ ID NO: 759
  Synthetic polypeptide
  MOD_RES (2)..(2): Xaa is AIB
  MOD_RES (20)..(20): Xaa is AIB
  MOD_RES (24)..(24): Pegylated
  MOD_RES (40)..(40): C-terminal amidation

SEQ ID NO: 764 - protein, 40 aa, Artificial Sequence; identical to SEQ ID NO: 756
  Synthetic polypeptide
  MOD_RES (2)..(2): Xaa is AIB
  MOD_RES (20)..(20): Xaa is AIB
  MOD_RES (40)..(40): Acylated with fatty acyl group
  MOD_RES (40)..(40): C-terminal amidation

SEQ ID NO: 765 - protein, 40 aa, Artificial Sequence
  Synthetic polypeptide
  MOD_RES (2)..(2): Xaa is AIB
  MOD_RES (10)..(10): Acylated with fatty acyl group via dipeptide spacer
  MOD_RES (20)..(20): Xaa is AIB
  MOD_RES (40)..(40): C-terminal amidation
YXEGTFTSDKSIYLDKQAAXEFVNWLLAGGPSSGAPPPSK

SEQ ID NO: 766 - protein, 40 aa, Artificial Sequence
  Synthetic polypeptide
  MOD_RES (2)..(2): Xaa is AIB
  MOD_RES (20)..(20): Xaa is AIB
  MOD_RES (24)..(24): Pegylated
  MOD_RES (40)..(40): C-terminal amidation
YXQGTFTSDYSIYLDKQAAXEFVCWLLAGGPSSGAPPPSK

SEQ ID NO: 767 - protein, 29 aa, Artificial Sequence
  Synthetic peptide
  MOD_RES (3)..(3): Xaa is Acetyldiaminobutanoic acid
  MOD_RES (16)..(16): Xaa is AIB
  MOD_RES (29)..(29): C-terminal amidation
HSXGTFTSDYSKYLDXRRAADFVAWLLDE

SEQ ID NO: 768 - protein, 29 aa, Artificial Sequence
  Synthetic peptide
  MOD_RES (3)..(3): Xaa is Acetyldiaminobutanoic acid
  MOD_RES (16)..(16): Xaa is AIB
  MOD_RES (29)..(29): C-terminal amidation
HSXGTFTSDYSKYLDXERAADFVAWLLDE

SEQ ID NO: 769 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (26)..(26): Pegylated
  MOD_RES (31)..(31): C-terminal amidation
XXHXEGTFTSDYSKYLDEQAAKEFICWLMNT

SEQ ID NO: 770 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group
  MOD_RES (18)..(18): Xaa is AIB
  MOD_RES (31)..(31): C-terminal amidation
XXHXQGTFTSDKSKYLDXRAAQDFVQWLMDT

SEQ ID NO: 771 - protein, 42 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (42)..(42): C-terminal amidation
XXHXEGTFTSDVSSYLEEQAAKEFIAWLVKGGPSSGAPPPSK

SEQ ID NO: 772 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): d-Ser
  MISC_FEATURE (18)..(22): Lactam ring between side chains of amino acids at positions 18 and 22
  MOD_RES (26)..(26): Pegylated
  MOD_RES (31)..(31): C-terminal amidation
XXHSQGTFTSDYSLYLDERAAKDFVCWLLDT

SEQ ID NO: 773 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (18)..(18): Xaa is AIB
  MOD_RES (22)..(22): Xaa is AIB
  MOD_RES (26)..(26): Pegylated
  MOD_RES (31)..(31): C-terminal amidation
XXHXQGTFTSDYSKYLDXKRAXEFVCWLLDT

SEQ ID NO: 774 - protein, 31 aa, Artificial Sequence; identical to SEQ ID NO: 770
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group via dipeptide spacer
  MOD_RES (18)..(18): Xaa is AIB
  MOD_RES (31)..(31): C-terminal amidation

SEQ ID NO: 775 - protein, 31 aa, Artificial Sequence; identical to SEQ ID NO: 770
  Synthetic peptide
  MOD_RES (1)..(1): Xaa is AIB, d-Cys, d-Lys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group via acidic amino acid spacer
  MOD_RES (18)..(18): Xaa is AIB
  MOD_RES (31)..(31): C-terminal amidation

SEQ ID NO: 776 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): d-Ser
  MOD_RES (12)..(12): Acylated with fatty acyl group via dipeptide spacer
  MOD_RES (18)..(18): Xaa is AIB
  MOD_RES (31)..(31): C-terminal amidation
XXHSQGTFTSDKSKYLDXRAAQDFVQWLMDT

SEQ ID NO: 777 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group via dipeptide spacer
  MOD_RES (18)..(18): Xaa is AIB
  MOD_RES (31)..(31): C-terminal amidation
XXHXQGTFTSDKSKYLDXRAAQDFVQWLLDT

SEQ ID NO: 778 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group via dipeptide spacer
  MOD_RES (31)..(31): C-terminal amidation
XXHXQGTFTSDKSKYLDERAAQDFVQWLMDT

SEQ ID NO: 779 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group via dipeptide spacer
  MOD_RES (18)..(18): Xaa is AIB
  MOD_RES (31)..(31): C-terminal amidation
XXHXQGTFTSDKSKYLEXRAAQDFVQWLMDT

SEQ ID NO: 780 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): d-Ser
  MOD_RES (12)..(12): Acylated with fatty acyl group via acidic amino acid spacer
  MOD_RES (31)..(31): C-terminal amidation
XXHSQGTFTSDKSKYLDERAAQDFVQWLLDT

SEQ ID NO: 781 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group via acidic amino acid spacer
  MOD_RES (31)..(31): C-terminal amidation
XXHXQGTFTSDKSKYLDEQAAKEFIAWLLDT

SEQ ID NO: 782 - protein, 42 aa, Artificial Sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is Aib
  MOD_RES (22)..(22): Xaa is Aib
  MOD_RES (42)..(42): C-terminal amidation
XXYXEGTFTSDYSIYLDKQAAXEFVNWLLAGGPSSGAPPPSK

SEQ ID NO: 783 - protein, 41 aa, Artificial Sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is Aib
  MOD_RES (22)..(22): Xaa is Aib
  MOD_RES (41)..(41): C-terminal amidation
XXYXEGTFTSDYSIYLDKQAAXEFVNWLLAGGPSSGAPPPS

SEQ ID NO: 784 - protein, 41 aa, Artificial Sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is Aib
  MOD_RES (12)..(12): Acylated with fatty acyl group via dipeptide spacer
  MOD_RES (22)..(22): Xaa is AIB
  MOD_RES (41)..(41): C-terminal amidation
XXYXEGTFTSDKSIYLDKQAAXEFVNWLLAGGPSSGAPPPS

SEQ ID NO: 785 - protein, 42 aa, Artificial Sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (22)..(22): Xaa is AIB
  MOD_RES (26)..(26): Pegylated
  MOD_RES (42)..(42): C-terminal amidation
XXYXEGTFTSDYSIYLDKQAAXEFVCWLLAGGPSSGAPPPSK

SEQ ID NO: 786 - protein, 42 aa, Artificial Sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (22)..(22): Xaa is AIB
  MOD_RES (42)..(42): Pegylated
  MOD_RES (42)..(42): C-terminal amidation
XXYXEGTFTSDYSIYLDKQAAXEFVNWLLAGGPSSGAPPPSC

SEQ ID NO: 787 - protein, 42 aa, Artificial sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MISC_FEATURE (18)..(22): Lactam bridge between side chains of amino acids at positions 18 and 22
  MOD_RES (42)..(42): Pegylated
  MOD_RES (42)..(42): C-terminal amidation
XXYXEGTFTSDYSIYLDEQAAKEFVNWLLAGGPSSGAPPPSC

SEQ ID NO: 788 - protein, 42 aa, Artificial Sequence; identical to SEQ ID NO: 786
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (22)..(22): Xaa is AIB
  MOD_RES (42)..(42): Pegylated
  MOD_RES (42)..(42): C-terminal amidation

SEQ ID NO: 789 - protein, 42 aa, Artificial Sequence; identical to SEQ ID NO: 785
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (22)..(22): Xaa is AIB
  MOD_RES (26)..(26): Pegylated
  MOD_RES (42)..(42): C-terminal amidation

SEQ ID NO: 790 - protein, 42 aa, Artificial Sequence; identical to SEQ ID NO: 782
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (22)..(22): Xaa is AIB
  MOD_RES (42)..(42): Acylated with fatty acyl group
  MOD_RES (42)..(42): C-terminal amidation

SEQ ID NO: 791 - protein, 42 aa, Artificial Sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (12)..(12): Acylated with fatty acyl group via dipeptide spacer
  MOD_RES (22)..(22): Xaa is AIB
  MOD_RES (42)..(42): C-terminal amidation
XXYXEGTFTSDKSIYLDKQAAXEFVNWLLAGGPSSGAPPPSK

SEQ ID NO: 792 - protein, 42 aa, Artificial Sequence
  Synthetic polypeptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (4)..(4): Xaa is AIB
  MOD_RES (22)..(22): Xaa is AIB
  MOD_RES (26)..(26): Pegylated
  MOD_RES (42)..(42): C-terminal amidation
XXYXQGTFTSDYSIYLDKQAAXEFVCWLLAGGPSSGAPPPSK

SEQ ID NO: 793 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (5)..(5): Xaa is Acetyldiaminobutanoic acid
  MOD_RES (18)..(18): Xaa is AIB
  MOD_RES (31)..(31): C-terminal amidation
XXHSXGTFTSDYSKYLDXRRAADFVAWLLDE

SEQ ID NO: 794 - protein, 31 aa, Artificial Sequence
  Synthetic peptide
  MOD_RES (1)..(1): Xaa is AIB, d-Lys, d-Cys, d-Ala
  MOD_RES (2)..(2): Xaa is Gly(N-Hexyl), Gly(N-Methyl), Phe(N-Methyl)
  MOD_RES (5)..(5): Xaa is Acetyldiaminobutanoic acid
  MOD_RES (18)..(18): Xaa is AIB
  MOD_RES (31)..(31): C-terminal amidation
XXHSXGTFTSDYSKYLDXERAADFVAWLLDE

SEQ ID NO: 795-800 - skipped (6 entries)

SEQ ID NO: 801 - protein, 29 aa, Homo sapiens
HSQGTFTSDYSKYLDSRRAQDFVQWLMNT

SEQ ID NO: 802 - protein, 29 aa, Artificial Sequence
  Glucagon analogue
  MOD_RES (16)..(16): Xaa is Ser, Cys, Orn, homocysteine or acetyl phenyalanine
  MOD_RES (27)..(27): Xaa is Met, Leu or Nle
HSQGTFTSDYSKYLDXRRAQDFVQWLXDT

SEQ ID NO: 803 - protein, 29 aa, Artificial Sequence
  Glucagon analogue
  MOD_RES (17)..(17): Xaa is Arg, Cys, Orn, homocysteine or acetyl phenyalanine
  MOD_RES (27)..(27): Xaa is Met, Leu or Nle
HSQGTFTSDYSKYLDSXRAQDFVQWLXDT

SEQ ID NO: 804 - protein, 29 aa, Artificial Sequence
  Glucagon analogue
  MOD_RES (21)..(21): Xaa is Asp, Cys, Orn, homocysteine or acetyl phenylalanine
  MOD_RES (27)..(27): Xaa is Met, Leu or Nle
HSQGTFTSDYSKYLDSRRAQXFVQWLXDT

SEQ ID NO: 805 - protein, 29 aa, Artificial Sequence
  Synthetic peptide
  MOD_RES (24)..(24): Xaa is Gln, Cys, Orn, homocysteine or acetyl phenylalanine
  MOD_RES (27)..(27): Xaa is Met, Leu or Nle
HSQGTFTSDYSKYLDSRRAQDFVXWLXDT

SEQ ID NO: 806 - protein, 29 aa, Artificial Sequence
  Glucagon analogue
  MOD_RES (21)..(21): Xaa is Asp, Cys, Orn, homocysteine or acetyl phenyalanine
  MOD_RES (24)..(24): Xaa is Gln, Cys, Orn, homocysteine or acetyl phenyalanine
  MOD_RES (27)..(27): Xaa is Met, Leu or Nle
HSQGTFTSDYSKYLDSRRAQXFVXWLXDT

SEQ ID NO: 807 - protein, 29 aa, Artificial Sequence
  Glucagon analogue
  MOD_RES (27)..(27): Xaa is Met, Leu or Nle
  MOD_RES (28)..(28): Xaa is Lys, Arg, His, Asp, Glu, cysteic acid or homocysteic acid
  MOD_RES (29)..(29): Xaa is Thr, Lys, Arg, His, Asp, Glu, cysteic acid or homocysteic acid
HSQGTFTSDYSKYLDSRRAQDFVQWLXXX

SEQ ID NO: 808 - protein, 29 aa, Artificial Sequence
  Glucagon analogue
  MOD_RES (27)..(27): Xaa is Met, Leu or Nle
  MOD_RES (28)..(28): Xaa is Asp or Glu
  MOD_RES (29)..(29): Xaa is Thr, Asp or Glu
HSQGTFTSDYSKYLDSRRAQDFVQWLXXX

SEQ ID NO: 809 - protein, 29 aa, Artificial Sequence
  Glucagon analogue
  MOD_RES (27)..(27): Xaa is Met, Leu or Nle
  MOD_RES (29)..(29): Xaa is Asp or Glu
HSQGTFTSDYSKYLDSRRAQDFVQWLXNX

SEQ ID NO: 810 - protein, 29 aa, Artificial Sequence
  Synthetic peptide
  MOD_RES (27)..(27): Xaa is Met, Leu or Nle
HSQGTFTSDYSKYLDSRRAQDFVQWLXDT

SEQ ID NO: 811 - protein, 29 aa, Artificial Sequence
  Glucagon analogue
HSQGTFTSDYSKYLDSRRAQDFVQWLMDT

SEQ ID NO: 812 - protein, 29 aa, Artificial Sequence
  Glucagon analogue
  MOD_RES (29)..(29): Xaa is Lys, Arg or His
HSQGTFTSDYSKYLDSRRAQDFVQWLMNX

SEQ ID NO: 813 - protein, 29 aa, Artificial Sequence
  Glucagon analogue
HSQGTFTSDYSKYLESRRAQDFVQWLMDT

SEQ ID NO: 814 - protein, 29 aa, Artificial Sequence
  Synthetic peptide
  MOD_RES (16)..(16): Pegylation
  MOD_RES (27)..(27): Xaa is Met, Leu or Nle
HSQGTFTSDYSKYLDCRRAQDFVQWLXDT

SEQ ID NO: 815 - protein, 29 aa, Artificial Sequence
  Glucagon analogue
  MOD_RES (17)..(17): Pegylation
  MOD_RES (27)..(27): Xaa is Met, Leu or Nle
HSQGTFTSDYSKYLDSCRAQDFVQWLXDT

SEQ ID NO: 816 - protein, 29 aa, Artificial Sequence
  Glucagon analogue
  MOD_RES (21)..(21): Pegylation
  MOD_RES (27)..(27): Xaa is Met, Leu or Nle
HSQGTFTSDYSKYLDSRRAQCFVQWLXDT

SEQ ID NO: 817 - protein, 29 aa, Artificial Sequence
  Glucagon analogue
  MOD_RES (24)..(24): Pegylation
  MOD_RES (27)..(27): Xaa is Met, Leu or Nle
HSQGTFTSDYSKYLDSRRAQDFVCWLXDT

SEQ ID NO: 818 - protein, 29 aa, Artificial Sequence
  Glucagon analogue
  MOD_RES (21)..(21): Pegylation
  MOD_RES (27)..(27): Xaa is Met, Leu or Nle
HSQGTFTSDYSRYLDSRRAQKFVQWLXDT

SEQ ID NO: 819 - protein, 29 aa, Artificial Sequence
  Glucagon analogue
  MOD_RES (24)..(24): Pegylation
  MOD_RES (27)..(27): Xaa is Met, Leu or Nle
HSQGTFTSDYSRYLDSRRAQDFVKWLXDT

SEQ ID NO: 820 - protein, 10 aa, Artificial Sequence
  Synthetic peptide
  MISC_FEATURE: Peptide fragment representing carboxy terminal 10 amino acids of Exendin-4
GPSSGAPPPS

SEQ ID NO: 821 - protein, 8 aa, Artificial Sequence
  Synthetic peptide
  MISC_FEATURE: Peptide fragment representing the carboxy terminal 8 amino acids of oxyntomodulin
KRNRNNIA

SEQ ID NO: 822 - protein, 4 aa, Artificial Sequence
  Synthetic peptide
  MISC_FEATURE: Peptide fragment representing the amino 4 amino acids of oxyntomodulin carboxy terminus of SEQ ID NO: 21
KRNR

SEQ ID NO: 823 - protein, 10 aa, Artificial Sequence
  Synthetic peptide
  MISC_FEATURE: Peptide fragment representing the carboxy terminal 10 amino acids of Exendin-4
  MOD_RES (10)..(10): AMIDATION
GPSSGAPPPS

SEQ ID NO: 824 - protein, 39 aa, Artificial Sequence
  Glucagon analogue
HSQGTFTSDYSKYLDSRRAQDFVQWLMDTGPSSGAPPPS

SEQ ID NO: 825 - protein, 37 aa, Artificial Sequence; identical to SEQ ID NO: 706
  Glucagon analogue

SEQ ID NO: 826 - protein, 33 aa, Artificial Sequence
  Glucagon analogue
HSQGTFTSDYSKYLDSRRAQDFVQWLMDTKRNR

SEQ ID NO: 827 - protein, 29 aa, Artificial Sequence
  Glucagon analogue
HSQGTFTSDYSKYLDSCRAQDFVQWLMNT

SEQ ID NO: 828 - protein, 39 aa, Artificial Sequence; identical to SEQ ID NO: 36
  Synthetic peptide

SEQ ID NO: 829 - protein, 29 aa, Artificial Sequence
  Glucagon analogue
  MOD_RES (24)..(24): 2-butyrolactone bound through Cys thiol group
HSQGTFTSDYSKYLDSRRAQDFVQWLMNT

SEQ ID NO: 830 - protein, 29 aa, Artificial Sequence
  Glucagon analogue
  MOD_RES (24)..(24): Carboxymethyl group bound through Cys thiol group
HSQGTFTSDYSKYLDSRRAQDFVQWLMNT

SEQ ID NO: 831 - protein, 39 aa, Artificial Sequence; identical to SEQ ID NO: 36
  Glucagon analogue

SEQ ID NO: 832 - protein, 30 aa, Artificial Sequence
  Glucagon analog
  MOD_RES (30)..(30): Xaa is Asp, Glu, Lys, Arg or His
HSQGTFTSDYSKYLDSRRAQDFVQWLMDTX

SEQ ID NO: 833 - protein, 29 aa, Artificial Sequence
  Glucagon analogue
  MOD_RES (15)..(15): Xaa is Asp, Glu, cysteic acid, homoglutamic acid or homocysteic acid
  MOD_RES (27)..(27): Xaa is Met, Leu or Nle
  MOD_RES (28)..(28): Xaa is Asn, Lys, Arg, His, Asp or Glu
  MOD_RES (29)..(29): Xaa is Thr, Lys, Arg, His, Asp or Glu
HSQGTFTSDYSKYLXSRRAQDFVQWLXXX

SEQ ID NO: 834 - protein, 29 aa, Artificial Sequence
  Glucagon analogue
  MOD_RES (15)..(15): Xaa is Asp, Glu, cysteic acid, homoglutamic acid or homocysteic acid
  MOD_RES (27)..(27): Xaa is Met, Leu or Nle
  MOD_RES (28)..(28): Xaa is Asn or an acidic amino acid
  MOD_RES (29)..(29): Xaa is Thr or an acidic amino acid
HSQGTFTSDYSKYLXSRRAQDFVQWLXXX

SEQ ID NO: 835 - protein, 39 aa, Artificial Sequence
  Synthetic peptide
HSQGTFTSDYSKYLDSRRAQDFVQWLMETGPSSGAPPPS

SEQ ID NO: 836 - protein, 37 aa, Artificial Sequence
  Glucagon analogue
HSQGTFTSDYSKYLDSRRAQDFVQWLMETKRNRNNIA

SEQ ID NO: 837 - protein, 33 aa, Artificial Sequence
  Glucagon analogue
HSQGTFTSDYSKYLDSRRAQDFVQWLMETKRNR

SEQ ID NO: 838 - protein, 29 aa, Artificial Sequence
  Glucagon analogue
HSQGTFTSDYSKYLDSRRAQDFVQWLMET

SEQ ID NO: 839 - protein, 27 aa, Artificial Sequence
  Synthetic peptide
  MOD_RES (1)..(1): Xaa is any amino acid
  MOD_RES (2)..(2): Xaa is any amino acid
  MOD_RES (27)..(27): Met comprises Z
XXQGTFTSDYSKYLDSRRAQDFVQWLM

SEQ ID NO: 840 - protein, 29 aa, Artificial Sequence
  Synthetic peptide
  MOD_RES (1)..(1): Xaa is alpha, alpha-dimethyl imidiazole acetic acid (DMIA)
  MISC_FEATURE (16)..(20): Lactam bridge between residues 16 and 20
  MOD_RES (24)..(24): Pegylation
XSQGTFTSDYSKYLDERRAKDFVCWLMNT

SEQ ID NO: 841 - protein, 29 aa, Artificial Sequence
  Synthetic peptide
  MOD_RES (1)..(1): Xaa is alpha, alpha-dimethyl imidiazole acetic acid (DMIA)
  MISC_FEATURE (16)..(20): Lactam bridge between residues 16 and 20
  MOD_RES (24)..(24): Glutamine to alanine mutation
  MOD_RES (29)..(29): Pegylation
XSQGTFTSDYSKYLDERRAKDFVAWLMNC

SEQ ID NO: 842 - protein, 29 aa, Artificial Sequence
  Synthetic peptide
  MOD_RES (1)..(1): Xaa is alpha, alpha-dimethyl imidiazole acetic acid (DMIA)
  MISC_FEATURE (16)..(20): Lactam bridge between residues 16 and 20
  MOD_RES (24)..(24): Pegylation
  MOD_RES (27)..(27): Xaa is Nle or Leu
XSQGTFTSDYSKYLDERRAKDFVCWLXNT

SEQ ID NO: 843 - protein, 29 aa, Artificial Sequence
  Synthetic peptide
  MOD_RES (1)..(1): Xaa is alpha, alpha-dimethyl imidiazole acetic acid (DMIA)
  MISC_FEATURE (16)..(20): Lactam bridge between residues 16 and 20
  MISC_FEATURE (24)..(24): Glutamine to alanine mutation
  MISC_FEATURE (27)..(27): Xaa is Nle or Leu
  MOD_RES (29)..(29): Pegylation
XSQGTFTSDYSKYLDERRAKDFVAWLXNC

SEQ ID NO: 844 - protein, 29 aa, Artificial Sequence
  Synthetic peptide
  MISC_FEATURE: SEQ ID NO: 1 with  Ala 20, Ala 24, Nle 27, and Asp 28
  MOD_RES (27)..(27): Xaa is Nle
HSQGTFTSDYSKYLDSRRAADFVAWLXDT

SEQ ID NO: 845 - protein, 29 aa, Artificial Sequence
  Synthetic peptide
  MISC_FEATURE: SEQ ID NO: 1 with Ala 20, Ala 24, Nle27 , Asp 28, and Glu 29
  MOD_RES (27)..(27): Xaa is Nle
HSQGTFTSDYSKYLDSRRAADFVAWLXDE

SEQ ID NO: 846 - protein, 30 aa, Artificial Sequence
  Synthetic peptide
  MISC_FEATURE: SEQ ID NO: 1 with Ala 20, Ala 24, Nle 27, Asp 28, and Glu 30
  MOD_RES (27)..(27): Xaa is Nle
HSQGTFTSDYSKYLDSRRAADFVAWLXDTE

SEQ ID NO: 847 - protein, 29 aa, Artificial Sequence
  Synthetic peptide
  MISC_FEATURE: SEQ ID NO: 1 with Ala 20, Ala 24, Nle 27, Glu 28, and Glu 29
  MOD_RES (27)..(27): Xaa is Nle
HSQGTFTSDYSKYLDSRRAADFVAWLXEE

SEQ ID NO: 848 - protein, 30 aa, Artificial Sequence
  Synthetic peptide
  MISC_FEATURE: SEQ ID NO: 1 with Ala 20, Ala 24, Nle 27, Glu 28, and Glu 30
  MOD_RES (27)..(27): Xaa is Nle
HSQGTFTSDYSKYLDSRRAADFVAWLXETE

SEQ ID NO: 849 - protein, 30 aa, Artificial Sequence
  Synthetic peptide
  MOD_RES (27)..(27): Xaa is Nle
  MISC_FEATURE (27)..(27): SEQ ID NO: 1 with Ala 20, Ala 24, Nle 27, Glu 29, and Glu 30
HSQGTFTSDYSKYLDSRRAADFVAWLXNEE

SEQ ID NO: 850 - protein, 29 aa, Artificial Sequence
  Synthetic peptide
  MISC_FEATURE: SEQ ID NO: 1 with Ala 20, Glu 21, Ala 24, Nle 27, and Asp 28
  MOD_RES (27)..(27): Xaa is Nle
HSQGTFTSDYSKYLDSRRAAEFVAWLXDT

SEQ ID NO: 851 - protein, 29 aa, Artificial Sequence
  Synthetic peptide
  MISC_FEATURE: SEQ ID NO: 1 with Ala 20, Glu 21, Ala 24, Nle 27, Asp 28, and Glu 29
  MOD_RES (27)..(27): Xaa is Nle
HSQGTFTSDYSKYLDSRRAAEFVAWLXDE

SEQ ID NO: 852 - protein, 29 aa, Artificial Sequence
  Synthetic peptide
  MISC_FEATURE: SEQ ID NO: 1 with Ala 20, Glu 21, Ala 24, Nle 27, Asp 28, and Glu 30
  MOD_RES (27)..(27): Xaa is Nle
HSQGTFTSDYSKYLDSRRAAEFVAWLXDE

SEQ ID NO: 853 - protein, 29 aa, Artificial Sequence
  Synthetic peptide
  MISC_FEATURE: SEQ ID NO :1 with Ala 20, Glu 21, Ala 24, Nle 27, Glu 28, and Glu 29
  MOD_RES (27)..(27): Xaa is Nle
HSQGTFTSDYSKYLDSRRAAEFVAWLXEE

SEQ ID NO: 854 - protein, 29 aa, Artificial Sequence
  Synthetic peptide
  MISC_FEATURE: SEQ ID NO: 1 with Ala 20, Glu 21, Ala 24, Nle 27, Glu 28, and Glu 30
HSQGTFTSDYSKYLDSRRAQDFVQWLMNT

SEQ ID NO: 855 - protein, 30 aa, Artificial Sequence
  Synthetic peptide
  MISC_FEATURE: SEQ ID NO: 1 with Ala 20, Glu 21, Ala 24, Nle 27, Glu 29, and Glu 30
  MOD_RES (27)..(27): Xaa is Nle
HSQGTFTSDYSKYLDSRRAAEFVAWLXNEE

SEQ ID NO: 856 - protein, 29 aa, Artificial Sequence
  Synthetic peptide
  MISC_FEATURE: SEQ ID NO: 1 with Thr 16, Ala 20, Glu 21, Ala 24, Nle 27, Asp 28, and Glu29
  MOD_RES (27)..(27): Xaa is Nle
HSQGTFTSDYSKYLDTRRAAEFVAWLXDE

SEQ ID NO: 857 - protein, 31 aa, Homo sapiens; identical to SEQ ID NO: 50

SEQ ID NO: 858 - protein, 30 aa, Homo sapiens; identical to SEQ ID NO: 52
  MOD_RES (30)..(30): AMIDATION

SEQ ID NO: 859 - protein, 29 aa, Artificial Sequence
  Synthetic peptide
  MOD_RES (3)..(3): Xaa is Glutamine analog
  MOD_RES (27)..(27): Xaa is Nle
HSXGTFTSDYSKYLDTRRAAEFVAWLXDE

SEQ ID NO: 860 - protein, 29 aa, Artificial Sequence
  Synthetic peptide
  MOD_RES (3)..(3): Xaa is Glutamine analog
  MOD_RES (16)..(16): Xaa is Aminoisobutryic acid
HSXGTFTSDYSKYLDXRRAADFVAWLMDE

SEQ ID NO: 861 - protein, 29 aa, Artificial Sequence
  Synthetic peptide
  MOD_RES (27)..(27): Xaa is Nle
HSQGTFTSDYSKYLDTRRAAEFVAWLXDE

SEQ ID NO: 862 - protein, 29 aa, Artificial Sequence
  Synthetic peptide
  MOD_RES (3)..(3): Xaa is Acetamidomethyl-cysteine
  MOD_RES (27)..(27): Xaa is Nle
HSXGTFTSDYSKYLDTRRAAEFVAWLXDE

SEQ ID NO: 863 - protein, 29 aa, Artificial Sequence
  Synethic peptide
  MOD_RES (3)..(3): Xaa is Acetyldiaminobutanoic acid
  MOD_RES (27)..(27): Xaa is Nle
HSXGTFTSDYSKYLDTRRAAEFVAWLXDE

SEQ ID NO: 864 - protein, 29 aa, Artificial Sequence
  Synthetic peptide
  MOD_RES (3)..(3): Xaa is Carbamoyldiaminopropanoic acid
  MOD_RES (27)..(27): Xaa is Nle
HSXGTFTSDYSKYLDTRRAAEFVAWLXDE

SEQ ID NO: 865 - protein, 29 aa, Artificial Sequence
  Synthetic peptide
  MOD_RES (3)..(3): Xaa is Methylglutamine
  MOD_RES (27)..(27): Xaa is Nle
HSXGTFTSDYSKYLDTRRAAEFVAWLXDE

SEQ ID NO: 866 - protein, 29 aa, Artificial Sequence
  Synthetic peptide
  MOD_RES (3)..(3): Xaa is Methionine sulfoxide
  MOD_RES (27)..(27): Xaa is Nle
HSXGTFTSDYSKYLDTRRAAEFVAWLXDE

SEQ ID NO: 867 - protein, 29 aa, Artificial Sequence
  Synthetic peptide
  MOD_RES (3)..(3): Xaa is Acetylornithine
  MOD_RES (27)..(27): Xaa is Nle
HSXGTFTSDYSKYLDTRRAAEFVAWLXDE

SEQ ID NO: 868 - protein, 29 aa, Artificial Sequence
  Synthetic peptide
  MOD_RES (16)..(16): Xaa is Aminoisobutryic acid
HSQGTFTSDYSKYLDXRRAADFVAWLMDE

SEQ ID NO: 869 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryic acid
HSXGTFTSDYSKYLDXRRAADFVAWLMDE

SEQ ID NO: 870 - protein, 29 aa, Artificial Sequence
  Synthetic peptide
  MOD_RES (3)..(3): Xaa is Methylglutamine
  MOD_RES (16)..(16): Xaa is Aib
HSXGTFTSDYSKYLDXRRAADFVAWLMDE

SEQ ID NO: 871 - protein, 29 aa, Artificial Sequence
  Synthetic peptide
  MOD_RES (3)..(3): Xaa is acetyldiaminobutanoic acid
  MOD_RES (16)..(16): Xaa is Aib
HSXGTFTSDYSKYLDXRRAADFVAWLLDE

SEQ ID NO: 872 - protein, 39 aa, Artificial Sequence; identical to SEQ ID NO: 604
  Synthetic peptide
  MOD_RES (3)..(3): Xaa is Acetyldiaminobutanoic acid
  MOD_RES (16)..(16): Aminoisobutryic Acid
  MOD_RES (39)..(39): AMIDATION

SEQ ID NO: 873 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryric acid
HSXGTFTSDYSKYLDXRRASDFVSWLLDE

SEQ ID NO: 874 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryic acid
HSXGTFTSDYSKYLDXRRATDFVTWLLDE

SEQ ID NO: 875 - protein, 29 aa, Artificial Sequence
  Synthetic peptide
HSQGTFTSDYSKYLDSRRAQDFVQWLMDE

SEQ ID NO: 876 - protein, 29 aa, Artificial Sequence
  Synthetic peptide
  MOD_RES (16)..(16): Xaa is Aib
HSQGTFTSDYSKYLDXRRAQDFVQWLMDE

SEQ ID NO: 877 - protein, 29 aa, Artificial Sequence
  Synthetic peptide
  misc_feature (3)..(3): Xaa can be any naturally occurring amino acid
HSXGTFTSDYSKYLDSRRAQDFVQWLMNT

SEQ ID NO: 878 - protein, 29 aa, Artificial Sequence
  Synthetic peptide
HSQGTFTSDYSKYLDSRRAQDFVQWLMDT

SEQ ID NO: 879 - protein, 30 aa, Artificial Sequence; identical to SEQ ID NO: 581
  Synthetic peptide
  MOD_RES (2)..(2): Xaa is d-Ser
  MOD_RES (30)..(30): Acylated with a C14 fatty acyl group
  MOD_RES (30)..(30): AMIDATION

SEQ ID NO: 880 - protein, 29 aa, Artificial Sequence
  Synthetic peptide
  MOD_RES (2)..(2): Xaa is d-Ser
  MOD_RES (10)..(10): Acylated with a C14 fatty acyl group
  MOD_RES (29)..(29): AMIDATION
HXQGTFTSDKSKYLDERRAKDFVQWLMNT

SEQ ID NO: 881 - protein, 30 aa, Artificial Sequence; identical to SEQ ID NO: 581
  Synthetic peptide
  MOD_RES (2)..(2): Xaa is d-Ser
  MOD_RES (30)..(30): Acylated with a C16 fatty acyl group
  MOD_RES (30)..(30): AMIDATION

SEQ ID NO: 882 - protein, 29 aa, Artificial Sequence
  Synthetic peptide
  MOD_RES (2)..(2): Xaa is d-Ser
  MOD_RES (10)..(10): Acylated with a C16 fatty acyl group
  MOD_RES (29)..(29): AMIDATION
HXQGTFTSDKSKYLDERRAKDFVQWLMNT

SEQ ID NO: 883 - protein, 29 aa, Artificial Sequence
  Synthetic peptide
  MOD_RES (2)..(2): Aminoisobutryic Acid
  MOD_RES (10)..(10): Acylated with a C18 fatty acyl group
  MOD_RES (24)..(24): Cys-PEG
  MOD_RES (29)..(29): AMIDATION
HXQGTFTSDKSKYLDEQAAKEFICWLMNT

SEQ ID NO: 884 - protein, 30 aa, Artificial Sequence; identical to SEQ ID NO: 586
  Synthetic peptide
  MOD_RES (2)..(2): Aminoisobutryic Acid
  MOD_RES (24)..(24): Cys-PEG
  MOD_RES (30)..(30): Acylated with a C18 fatty acyl group
  MOD_RES (30)..(30): AMIDATION

SEQ ID NO: 885 - protein, 29 aa, Artificial sequence
  Synthetic peptide
  MOD_RES (16)..(16): Xaa is Ser or alpha, alpha-disubstituted amino acid
  MOD_RES (20)..(20): Xaa is Gln or alpha, alpha-disubstituted amino acid
  MOD_RES (21)..(21): Xaa is Asp or alpha, alpha-disubstituted amino acid
  MOD_RES (24)..(24): Xaa is Gln or alpha, alpha-disubstituted amino acid
HSQGTFTSDYSKYLDXRRAXXFVXWLMNT

SEQ ID NO: 886 - protein, 29 aa, Artificial Sequence
  Synthetic peptide
  MOD_RES (16)..(16): Xaa is Aib
HSQGTFTSDYSKYLDXRRAQDFVQWLMNT

SEQ ID NO: 887 - protein, 29 aa, Artificial Sequence
  Synthetic peptide
  MOD_RES (19)..(19): Xaa is Aib
HSQGTFTSDYSKYLDSRRXQDFVQWLMNT

SEQ ID NO: 888 - protein, 29 aa, Artificial Sequence
  Synthetic peptide
  MOD_RES (20)..(20): Xaa is Aib
HSQGTFTSDYSKYLDSRRAXDFVQWLMNT

SEQ ID NO: 889 - protein, 29 aa, Artificial Sequence
  Synthetic peptide
  MOD_RES (21)..(21): Xaa is Aib
HSQGTFTSDYSKYLDSRRAQXFVQWLMNT

SEQ ID NO: 890 - protein, 29 aa, Artificial Sequence
  Synthetic peptide
  MOD_RES (24)..(24): Xaa is Aib
HSQGTFTSDYSKYLDSRRAQDFVXWLMNT

SEQ ID NO: 891 - protein, 29 aa, Artificial Sequence
  Synthetic peptide
  MOD_RES (16)..(16): Xaa is Aib
  MOD_RES (20)..(20): Xaa is Aib
HSQGTFTSDYSKYLDXRRAXDFVQWLMNT

SEQ ID NO: 892 - protein, 29 aa, Artificial Sequence
  Synthetic peptide
  MOD_RES (16)..(16): Xaa is Aib
  MOD_RES (24)..(24): Xaa is Aib
HSQGTFTSDYSKYLDXRRAQDFVXWLMNT

SEQ ID NO: 893 - protein, 29 aa, Artificial Sequence
  Synthetic peptide
  MOD_RES (20)..(20): Xaa is Aib
  MOD_RES (24)..(24): Xaa is Aib
HSQGTFTSDYSKYLDSRRAXDFVXWLMNT

SEQ ID NO: 894 - protein, 29 aa, Artificial Sequence
  Synthetic peptide
  MOD_RES (16)..(16): Xaa is Aib
  MOD_RES (20)..(20): Xaa is Aib
  MOD_RES (24)..(24): Xaa is Aib
HSQGTFTSDYSKYLDXRRAXDFVXWLMNT

SEQ ID NO: 895 - protein, 29 aa, Artificial Sequence
  Synthetic peptide
  MOD_RES (2)..(2): Xaa is Aib
  MOD_RES (16)..(16): Xaa is Aib
  MOD_RES (29)..(29): AMIDATION
HXQGTFTSDKSKYLDXRRAQDFVQWLMNT

SEQ ID NO: 896 - protein, 29 aa, Artificial Sequence
  Synthetic peptide
  MOD_RES (2)..(2): Xaa is Aib
  MOD_RES (16)..(16): Xaa is Aib
  MOD_RES (29)..(29): AMIDATION
HXQGTFTSDYSKYLDXRRAQDFVQWLMNT

SEQ ID NO: 897 - protein, 29 aa, Artificial Sequence
  Synthetic peptide
  MOD_RES (2)..(2): Xaa is Aib
  MOD_RES (10)..(10): Acylated with a C16 fatty acyl group
  MOD_RES (16)..(16): Xaa is Aib
  MOD_RES (29)..(29): AMIDATION
HXQGTFTSDKSKYLDXRRAQDFVQWLMNT

SEQ ID NO: 898 - protein, 29 aa, Artificial Sequence
  Synthetic peptide
  MOD_RES (2)..(2): Xaa is Aib
  MOD_RES (10)..(10): Acylated with a C16 fatty acyl group via Ala-Ala spacer
  MOD_RES (16)..(16): Xaa is Aib
  MOD_RES (29)..(29): AMIDATION
HXQGTFTSDKSKYLDXRRAQDFVQWLMNT

SEQ ID NO: 899 - protein, 29 aa, Artificial Sequence
  Synthetic peptide
  MOD_RES (2)..(2): Xaa is Aib
  MOD_RES (10)..(10): Acylated with a C16 fatty acyl group via dipeptide spacer
  MOD_RES (16)..(16): Xaa is Aib
  MOD_RES (29)..(29): AMIDATION
HXQGTFTSDKSKYLDXRRAQDFVQWLMNT

SEQ ID NO: 900 - protein, 29 aa, Artificial Sequence
  Synthetic peptide
  MOD_RES (2)..(2): Xaa is Aib
  MOD_RES (10)..(10): Acylated with a C16 fatty acyl group via beta-Ala-beta-Ala spacer
  MOD_RES (16)..(16): Xaa is Aib
  MOD_RES (29)..(29): AMIDATION
HXQGTFTSDKSKYLDXRRAQDFVQWLMNT

SEQ ID NO: 901 - protein, 29 aa, Artificial Sequence
  Synthetic peptide
  MOD_RES (2)..(2): Xaa is Aib
  MOD_RES (10)..(10): Acylated with a C16 fatty acyl group via 6-aminohexanoic acid spacer
  MOD_RES (16)..(16): Xaa is Aib
  MOD_RES (29)..(29): AMIDATION
HXQGTFTSDKSKYLDXRRAQDFVQWLMNT

SEQ ID NO: 902 - protein, 29 aa, Artificial Sequence
  Synthetic peptide
  MOD_RES (2)..(2): Xaa is Aib
  MOD_RES (10)..(10): Acylated with a C16 fatty acyl group via Leu-Leu spacer
  MOD_RES (16)..(16): Xaa is Aib
  MOD_RES (29)..(29): AMIDATION
HXQGTFTSDKSKYLDXRRAQDFVQWLMNT

SEQ ID NO: 903 - protein, 29 aa, Artificial Sequence
  Synthetic peptide
  MOD_RES (2)..(2): Xaa is Aib
  MOD_RES (10)..(10): Acylated with a C16 fatty acyl group via Pro-Pro spacer
  MOD_RES (16)..(16): Xaa is Aib
  MOD_RES (29)..(29): AMIDATION
HXQGTFTSDKSKYLDXRRAQDFVQWLMNT

SEQ ID NO: 904 - protein, 29 aa, Artificial Sequence
  Synthetic peptide
  MOD_RES (2)..(2): Xaa is Aib
  MOD_RES (10)..(10): Acylated with a C14 fatty acyl group
  MOD_RES (16)..(16): Xaa is Aib
  MOD_RES (24)..(24): Cys-PEG
  MOD_RES (29)..(29): AMIDATION
HXQGTFTSDKSKYLDXRRAQDFVCWLMNT

SEQ ID NO: 905 - protein, 29 aa, Artificial Sequence
  Synthetic peptide
  MOD_RES (2)..(2): Xaa is Aib
  MOD_RES (10)..(10): Acylated with a C14 fatty acyl group via dipeptide spacer
  MOD_RES (16)..(16): Xaa is Aib
  MOD_RES (24)..(24): Cys-PEG
  MOD_RES (29)..(29): AMIDATION
HXQGTFTSDKSKYLDXRRAQDFVCWLMNT

SEQ ID NO: 906 - protein, 29 aa, Artificial Sequence
  Synthetic peptide
  MOD_RES (2)..(2): Xaa is Aib
  MOD_RES (10)..(10): Acylated with a C14 fatty acyl group via dipeptide spacer
  MOD_RES (16)..(16): Xaa is Aib
  MOD_RES (29)..(29): AMIDATION
HXQGTFTSDKSKYLDXRRAQDFVQWLMNT

SEQ ID NO: 907 - protein, 29 aa, Artificial Sequence
  Synthetic peptide
  MOD_RES (2)..(2): Xaa is Aib
  MOD_RES (10)..(10): Acylated with a C14 fatty acyl group via Ala-Ala spacer
  MOD_RES (16)..(16): Xaa is Aib
  MOD_RES (24)..(24): Cys-PEG
  MOD_RES (29)..(29): AMIDATION
HXQGTFTSDKSKYLDXRRAQDFVCWLMNT

SEQ ID NO: 908 - protein, 29 aa, Artificial Sequence
  Synthetic peptide
  MOD_RES (2)..(2): Xaa is Aib
  MOD_RES (10)..(10): Acylated with a C14 fatty acyl group via Ala-Ala spacer
  MOD_RES (16)..(16): Xaa is Aib
  MOD_RES (29)..(29): AMIDATION
HXQGTFTSDKSKYLDXRRAQDFVQWLMNT

SEQ ID NO: 909 - protein, 29 aa, Artificial Sequence
  Synthetic peptide
  MOD_RES (2)..(2): Xaa is Aib
  MOD_RES (10)..(10): Acylated with a C16 fatty acyl group via Ala-Ala spacer
  MOD_RES (16)..(16): Xaa is Aib
  MOD_RES (24)..(24): Cys-PEG
  MOD_RES (29)..(29): AMIDATION
HXQGTFTSDKSKYLDXRRAQDFVCWLMNT

SEQ ID NO: 910 - protein, 29 aa, Artificial Sequence
  Synthetic peptide
  MOD_RES (2)..(2): Xaa is Aib
  MOD_RES (10)..(10): Acylated with a C16 fatty acyl group via dipeptide spacer
  MOD_RES (16)..(16): Xaa is Aib
  MOD_RES (24)..(24): Cys-PEG
  MOD_RES (29)..(29): AMIDATION
HXQGTFTSDKSKYLDXRRAQDFVCWLMNT

SEQ ID NO: 911 - protein, 29 aa, Artificial Sequence
  Synthetic peptide
  MOD_RES (2)..(2): Xaa is Aib
  MOD_RES (10)..(10): Covalently bound to a C14 fatty acyl group
  MOD_RES (16)..(16): Xaa is Aib
  MOD_RES (29)..(29): AMIDATION
HXQGTFTSDKSKYLDXRRAQDFVCWLMNT

SEQ ID NO: 912 - protein, 29 aa, Artificial Sequence
  Synthetic peptide
  MOD_RES (2)..(2): Xaa is Aib
  MOD_RES (10)..(10): Covalently bound to C14 fatty acyl group via dipeptide spacer
  MOD_RES (16)..(16): Xaa is Aib
  MOD_RES (29)..(29): AMIDATION
HXQGTFTSDKSKYLDXRRAQDFVCWLMNT

SEQ ID NO: 913 - protein, 29 aa, Artificial Sequence
  Synthetic peptide
  MOD_RES (2)..(2): Xaa is Aib
  MOD_RES (10)..(10): Covalently bound to C14 fatty acyl group via Ala-Ala spacer
  MOD_RES (16)..(16): Xaa is Aib
  MOD_RES (29)..(29): AMIDATION
HXQGTFTSDKSKYLDXRRAQDFVCWLMNT

SEQ ID NO: 914 - protein, 29 aa, Artificial Sequence
  Synthetic peptide
  MOD_RES (2)..(2): Xaa is Aib
  MOD_RES (10)..(10): Covalently bound to C16 fatty acyl group via dipeptide spacer
  MOD_RES (16)..(16): Xaa is Aib
  MOD_RES (29)..(29): AMIDATION
HXQGTFTSDKSKYLDXRRAQDFVCWLMNT

SEQ ID NO: 915 - protein, 29 aa, Artificial Sequence
  Synthetic peptide
  MOD_RES (2)..(2): Xaa is Aib
  MOD_RES (10)..(10): Covelently bound to C16 fatty acyl group via Ala-Ala spacer
  MOD_RES (16)..(16): Xaa is Aib
  MOD_RES (29)..(29): AMIDATION
HXQGTFTSDKSKYLDXRRAQDFVCWLMNT

SEQ ID NO: 916 - protein, 30 aa, Artificial Sequence; identical to SEQ ID NO: 581
  Synthetic peptide
  MOD_RES (2)..(2): D-serine, D-alanine, valine, amino n-butyric acid, glycine, N-methyl serine, aminoisobutyric acid
  MOD_RES (30)..(30): Acylated with a C14 fatty acyl group
  MOD_RES (30)..(30): AMIDATION

SEQ ID NO: 917 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with a C14 fatty acyl group
  MOD_RES (29)..(29): AMIDATION
HXQGTFTSDKSKYLDERRAKDFVQWLMNT

SEQ ID NO: 918 - protein, 30 aa, Artificial Sequence; identical to SEQ ID NO: 581
  Synthetic peptide
  MOD_RES (2)..(2): D-serine, D-alanine, valine, amino n-butyric acid, glycine, N-methyl serine, aminoisobutyric acid
  MOD_RES (30)..(30): Acylated with a C16 fatty acyl group
  MOD_RES (30)..(30): AMIDATION

SEQ ID NO: 919 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with a C16 fatty acyl group
  MOD_RES (29)..(29): AMIDATION
HXQGTFTSDKSKYLDERRAKDFVQWLMNT

SEQ ID NO: 920-1000 - skipped (81 entries)

SEQ ID NO: 1001 - protein, 29 aa, Homo sapiens
  MISC_FEATURE: Wild type glucagon
HSQGTFTSDYSKYLDSRRAQDFVQWLMNT

SEQ ID NO: 1002 - protein, 31 aa, Homo sapiens; identical to SEQ ID NO: 50
  MISC_FEATURE (1)..(31): GLP-1(7-37)

SEQ ID NO: 1003 - protein, 30 aa, Artificial sequence; identical to SEQ ID NO: 52
  Synthetic polypeptide
  MISC_FEATURE (1)..(30): GLP-1(7-36) amidated
  MISC_FEATURE (30)..(30): C-terminal amidation

SEQ ID NO: 1004 - protein, 42 aa, Homo sapiens; identical to SEQ ID NO: 707
  mat_peptide (1)..(42): gastric inhibitory polypeptide

SEQ ID NO: 1005 - protein, 29 aa, Artificial sequence
  Synthetic polypeptide
  MISC_FEATURE: Analog 61
  MISC_FEATURE (16)..(20): Lactam bridge between residues 16 and 20.
HSQGTFTSDYSKYLDEIHQKEFIAWLMNT

SEQ ID NO: 1006 - protein, 29 aa, Artificial sequence
  Synthetic polypeptide
  MISC_FEATURE: Analog 62
  MISC_FEATURE (16)..(20): Lactam bridge between residues 16 and 20.
HSQGTFTSDYSIYLDEIHQKEFIAWLMNT

SEQ ID NO: 1007 - protein, 29 aa, Artificial sequence
  Synthetic polypeptide
  MISC_FEATURE: Analog 63
  MISC_FEATURE (12)..(16): Lactam bridge between residues 12 and 16.
HSQGTFTSDYSKYLDEIHQKEFIAWLMNT

SEQ ID NO: 1008 - protein, 29 aa, Artificial sequence
  Synthetic polypeptide
  MISC_FEATURE: Analog 66
HSQGTFTSDYSKYLDEIHQKEFIAWLLAQ

SEQ ID NO: 1009 - protein, 29 aa, Artificial sequence
  Synthetic polypeptide
  MISC_FEATURE: Analog 68
HSQGTFTSDYSKYLDKIHQEEFIAWLMNT

SEQ ID NO: 1010 - protein, 29 aa, Artificial sequence
  Synthetic polypeptide
  MISC_FEATURE: Analog 69
  MISC_FEATURE (16)..(20): Lactam bridge between residues 16 and 20
HSQGTFTSDYSKYLDKIHQEEFIAWLMNT

SEQ ID NO: 1011 - protein, 29 aa, Artificial sequence
  Synthetic polypeptide
  MISC_FEATURE: Analog 84
  MISC_FEATURE (16)..(20): Lactam bridge between residues 16 and 20
HSQGTFTSDYSIYLDEIHQKEFICWLLAQ

SEQ ID NO: 1012 - protein, 29 aa, Artificial sequence
  Synthetic polypeptide
  MISC_FEATURE: Analog 85
  MISC_FEATURE (16)..(20): Lactam bridge between residues 16 and 20
  MISC_FEATURE (24)..(24): PEG (20kDa) covalently attached to Cysteine
HSQGTFTSDYSIYLDEIHQKEFICWLLAQ

SEQ ID NO: 1013 - protein, 29 aa, Artificial sequence
  Synthetic polypeptide
  MISC_FEATURE: Analog 92
HSQGTFTSDYSIYLDEKHQKEFIAWLLAQ

SEQ ID NO: 1014 - protein, 29 aa, Artificial sequence
  Synthetic polypeptide
  MISC_FEATURE: Analog 93
  MISC_FEATURE (16)..(20): Lactam bridge between residues 16 and 20
  MISC_FEATURE (17)..(21): Lactam bridge between residues 17 and 21
HSQGTFTSDYSIYLDEKHQKEFIAWLLAQ

SEQ ID NO: 1015 - protein, 29 aa, Artificial sequence
  Synthetic polypeptide
  MISC_FEATURE: Analog 95
  MISC_FEATURE (16)..(20): Lactam bridge between residues 16 and 20
HAEGTFISDYSIAMDEIHQKDFVNWLLAQ

SEQ ID NO: 1016 - protein, 29 aa, Artificial sequence
  Synthetic polypeptide
  MISC_FEATURE: Analog 96
  MISC_FEATURE (16)..(20): Lactam bridge between residues 16 and 20
YAEGTFISDYSIAMDEIHQKDFVNWLLAQ

SEQ ID NO: 1017 - protein, 29 aa, Artificial sequence
  Synthetic polypeptide
  MISC_FEATURE: Analog 97
  MISC_FEATURE (16)..(20): Lactam bridge between residues 16 and 20
HAEGTFTSDYSIYMDEIHQKDFVNWLLAQ

SEQ ID NO: 1018 - protein, 29 aa, Artificial sequence
  Synthetic polypeptide
  MISC_FEATURE: Analog 98
  MISC_FEATURE (16)..(20): Lactam bridge between residues 16 and 20
YAEGTFTSDYSIYMDEIHQKDFVNWLLAQ

SEQ ID NO: 1019 - protein, 42 aa, Artificial sequence
  Synthetic polypeptide
  MISC_FEATURE: Analog 99
YAEGTFISDYSIAMDKIHQQDFVNWLLAQKGKKNWLKHNITQ

SEQ ID NO: 1020 - protein, 42 aa, Artificial sequence
  Synthetic polypeptide
  MISC_FEATURE: Analog 100
  MOD_RES (2)..(2): Xaa is Aib
YXEGTFISDYSIAMDKIHQQDFVNWLLAQKGKKNWLKHNITQ

SEQ ID NO: 1021 - protein, 42 aa, Artificial sequence
  Synthetic polypeptide
  MISC_FEATURE: Analog 101
YAPGTFISDYSIAMDKIHQQDFVNWLLAQKGKKNWLKHNITQ

SEQ ID NO: 1022 - protein, 42 aa, Artificial sequence
  Synthetic polypeptide
  MISC_FEATURE: Analog 102
  MOD_RES (2)..(2): Xaa is Aib
YXEGTFISDYSIAMDKIHQQDFVCWLLAQKGKKNWLKHNITQ

SEQ ID NO: 1023 - protein, 42 aa, Artificial sequence
  Synthetic polypeptide
  MISC_FEATURE: Analog 104
YAPGTFISDYSIAMDKIHQQDFVCWLLAQKGKKNWLKHNITQ

SEQ ID NO: 1024 - protein, 42 aa, Artificial sequence; identical to SEQ ID NO: 1023
  Synthetic polypeptide
  MISC_FEATURE: Analog 105
  MISC_FEATURE (24)..(24): PEG (40kDa) attached to Cysteine

SEQ ID NO: 1025 - protein, 29 aa, Artificial sequence
  Synthetic polypeptide
  MISC_FEATURE: Analog 106
YAEGTFISDYSIAMDKIHQQDFVNWLLAQ

SEQ ID NO: 1026 - protein, 29 aa, Artificial sequence
  Synthetic polypeptide
  MISC_FEATURE: Analog 107
  MISC_FEATURE (16)..(20): Lactam bridge between residues 16 and 20
HSQGTFISDYSKYLDEIHQKEFIAWLMNT

SEQ ID NO: 1027 - protein, 29 aa, Artificial sequence
  Synthetic polypeptide
  MISC_FEATURE: Analog 108
  MISC_FEATURE (16)..(20): Lactam bridge between residues 16 and 20
HSQGTFISDYSKALDEIHQKEFIAWLMNT

SEQ ID NO: 1028 - protein, 29 aa, Artificial sequence
  Synthetic polypeptide
  MISC_FEATURE: Analog 109
  MISC_FEATURE (16)..(20): Lactam bridge between residues 16 and 20
YSQGTFTSDYSKYLDEIHQKDFVNWLLAQ

SEQ ID NO: 1029 - protein, 29 aa, Artificial sequence
  Synthetic polypeptide
  MISC_FEATURE: Analog 110
  MISC_FEATURE (16)..(20): Lactam bridge between residues 16 and 20
YSQGTFTSDYSIYLDEIHQKDFVNWLLAQ

SEQ ID NO: 1030 - protein, 29 aa, Artificial sequence
  Synthetic polypeptide
  MISC_FEATURE: Analog 111
  MISC_FEATURE (16)..(20): Lactam bridge between residues 16 and 20
HSQGTFTSDYSKYLDEIHQKDFVNWLLAQ

SEQ ID NO: 1031 - protein, 24 aa, Artificial sequence
  Synthetic polypeptide
  MISC_FEATURE: Analog 113
  MOD_RES (1)..(1): Xaa is 3-phenyllactic acid
  MISC_FEATURE (11)..(15): Lactam bridge between residues 11 and 15
XISDYSIAMDEIHQKDFVNWLLAQ

SEQ ID NO: 1032 - protein, 24 aa, Artificial sequence
  Synthetic polypeptide
  MISC_FEATURE: Analog 114
  MOD_RES (1)..(1): Xaa is 3-phenyllactic acid
  MISC_FEATURE (11)..(15): Lactam bridge between residues 11 and 15
XTSDYSKYLDEIHQKDFVNWLLAQ

SEQ ID NO: 1033 - protein, 39 aa, Artificial sequence
  Synthetic polypeptide
  MISC_FEATURE: Analog 115
  MISC_FEATURE (16)..(20): Lactam bridge between residues 16 and 20
HSQGTFTSDYSKYLDEIHQKDFVNWLLAGGPSSGAPPPS

SEQ ID NO: 1034 - protein, 39 aa, Artificial sequence
  Synthetic polypeptide
  MISC_FEATURE: Analog 116
  MISC_FEATURE (16)..(20): Lactam bridge between residues 16 and 20
YSQGTFTSDYSKYLDEIHQKDFVNWLLAGGPSSGAPPPS

SEQ ID NO: 1035 - protein, 29 aa, Artificial sequence
  Synthetic polypeptide
  MISC_FEATURE: Analog 118
  MISC_FEATURE (16)..(20): Lactam bridge between residues 16 and 20
YSQGTFTSDYSKYLDEIHQKEFVNWLLAQ

SEQ ID NO: 1036 - protein, 39 aa, Artificial sequence
  Synthetic polypeptide
  MISC_FEATURE: Analog 120
  MISC_FEATURE (16)..(20): Lactam bridge between residues 16 and 20
YSQGTFTSDYSKYLDEQAAKEFIAWLMNGGPSSGAPPPS

SEQ ID NO: 1037 - protein, 29 aa, Artificial sequence
  Synthetic polypeptide
  MISC_FEATURE: Analog 124
  MISC_FEATURE (16)..(20): Lactam bridge between residues 16 and 20
HSQGTFTSDYSIYMDEIHQKDFVNWLLAQ

SEQ ID NO: 1038 - protein, 29 aa, Artificial sequence
  Synthetic polypeptide
  MISC_FEATURE: Analog 125
  MISC_FEATURE (16)..(20): Lactam bridge between residues 16 and 20
YSQGTFTSDYSIYMDEIHQKDFVNWLLAQ

SEQ ID NO: 1039 - protein, 39 aa, Artificial sequence
  Synthetic polypeptide
  MISC_FEATURE: Analog 127
  MISC_FEATURE (16)..(20): Lactam bridge between residues 16 and 20
YSQGTFTSDYSKYLDEQAAKEFVNWLLAGGPSSGAPPPS

SEQ ID NO: 1040 - protein, 39 aa, Artificial sequence
  Synthetic polypeptide
  MISC_FEATURE: Analog 128
  MISC_FEATURE (16)..(20): Lactam bridge between residues 16 and 20
HSQGTFTSDYSKYLDEIHQKDFIAWLMNGGPSSGAPPPS

SEQ ID NO: 1041 - protein, 39 aa, Artificial sequence
  Synthetic polypeptide
  MISC_FEATURE: Analog 129
  MISC_FEATURE (16)..(20): Lactam bridge between residues 16 and 20
YSQGTFTSDYSKYLDEIHQKDFIAWLMNGGPSSGAPPPS

SEQ ID NO: 1042 - protein, 39 aa, Artificial sequence
  Synthetic polypeptide
  MISC_FEATURE: Analog 139
  MISC_FEATURE (16)..(20): Lactam bridge between residues 16 and 20
YSQGTFTSDYSKYLDEQAAKEFIAWLLAGGPSSGAPPPS

SEQ ID NO: 1043 - protein, 39 aa, Artificial sequence
  Synthetic polypeptide
  MISC_FEATURE: Analog 140
  MISC_FEATURE (16)..(20): Lactam bridge between residues 16 and 20
YSQGTFTSDYSIYLDEQAAKEFVNWLLAGGPSSGAPPPS

SEQ ID NO: 1044 - protein, 39 aa, Artificial sequence
  Synthetic polypeptide
  MISC_FEATURE: Analog 141
  MISC_FEATURE (16)..(20): Lactam bridge between residuess 16 and 20
YSQGTFTSDYSKYMDEQAAKEFVNWLLAGGPSSGAPPPS

SEQ ID NO: 1045 - protein, 39 aa, Artificial sequence
  Synthetic polypeptide
  MISC_FEATURE: Analog 142
  MISC_FEATURE (16)..(20): Lactam bridge between residues 16 and 20
YAEGTFTSDYSIYMDEQAAKEFVNWLLAGGPSSGAPPPS

SEQ ID NO: 1046 - protein, 39 aa, Artificial sequence
  Synthetic polypeptide
  MISC_FEATURE: Analog 143
  MISC_FEATURE (16)..(20): Lactam bridge between residues 16 and 20
YSQGTFTSDYSKYLDERRAKEFVNWLLAGGPSSGAPPPS

SEQ ID NO: 1047 - protein, 39 aa, Artificial sequence
  Synthetic polypeptide
  MISC_FEATURE: Analog 144
  MISC_FEATURE (16)..(20): Lactam bridge between residues 16 and 20
YAQGTFTSDYSIYMDEQAAKEFVNWLLAGGPSSGAPPPS

SEQ ID NO: 1048 - protein, 39 aa, Artificial sequence
  Synthetic polypeptide
  MISC_FEATURE: Analog 145
  MISC_FEATURE (16)..(20): Lactam bridge between residues 16 and 20
YAQGTFISDYSKYLDEQAAKEFVNWLLAGGPSSGAPPPS

SEQ ID NO: 1049 - protein, 39 aa, Artificial sequence; identical to SEQ ID NO: 1048
  Synthetic polypeptide
  MISC_FEATURE: Analog 146
  MISC_FEATURE (16)..(20): Lactam bridge between residues 16 and 20

SEQ ID NO: 1050 - protein, 39 aa, Artificial sequence
  Synthetic polypeptide
  MISC_FEATURE: Analog 147
  MISC_FEATURE (16)..(20): Lactam bridge between residues 16 and 20
YSQGTFTSDYSIYLDEQAAKEFIAWLLAGGPSSGAPPPS

SEQ ID NO: 1051 - protein, 39 aa, Artificial sequence
  Synthetic polypeptide
  MISC_FEATURE: Analog 148
  MISC_FEATURE (16)..(20): Lactam bridge between residues 16 and 20
YSEGTFTSDYSIYLDEQAAKEFIAWLLAGGPSSGAPPPS

SEQ ID NO: 1052 - protein, 39 aa, Artificial sequence
  Synthetic polypeptide
  MISC_FEATURE: Analog 149
  MISC_FEATURE (16)..(20): Lactam bridge between residues 16 and 20
YAEGTFTSDYSIYLDEQAAKEFVNWLLAGGPSSGAPPPS

SEQ ID NO: 1053 - protein, 39 aa, Artificial sequence
  Synthetic polypeptide
  MISC_FEATURE: Analog 150
  MISC_FEATURE (16)..(20): Lactam bridge between residues 16 and 20
YSQGTFISDYSIYLDEQAAKEFVNWLLAGGPSSGAPPPS

SEQ ID NO: 1054 - protein, 39 aa, Artificial sequence; identical to SEQ ID NO: 1042
  Synthetic polypeptide
  MISC_FEATURE: Analog 151
  MISC_FEATURE (16)..(20): Lactam bridge between residues 16 and 20

SEQ ID NO: 1055 - protein, 39 aa, Artificial sequence
  Synthetic polypeptide
  MISC_FEATURE: Analog 152
  MOD_RES (2)..(2): Xaa is Aib
  MISC_FEATURE (16)..(20): Lactam bridge between residues 16 and 20
YXQGTFTSDYSIYLDEQAAKEFVNWLLAGGPSSGAPPPS

SEQ ID NO: 1056 - protein, 39 aa, Artificial sequence
  Synthetic polypeptide
  MISC_FEATURE: Analog 154
  MOD_RES (1)..(1): Xaa is hippuric acid
  MISC_FEATURE (16)..(20): Lactam bridge between residues 16 and 20
XSQGTFTSDYSIYLDEQAAKEFVNWLLAGGPSSGAPPPS

SEQ ID NO: 1057 - protein, 39 aa, Artificial sequence; identical to SEQ ID NO: 1039
  Synthetic polypeptide
  MISC_FEATURE: Analog 155
  MISC_FEATURE (12)..(16): Lactam bridge between residues 12 and 16

SEQ ID NO: 1058 - protein, 39 aa, Artificial sequence
  Synthetic polypeptide
  MISC_FEATURE: Analog 156
  MISC_FEATURE (20)..(24): Lactam bridge between residues 20 and 24
YSQGTFTSDYSIYLDEQAAKEFVEWLLAGGPSSGAPPPS

SEQ ID NO: 1059 - protein, 39 aa, Artificial sequence
  Synthetic polypeptide
  MISC_FEATURE: Analog 157
  MISC_FEATURE (24)..(28): Lactam bridge between residues 24 and 28
YSQGTFTSDYSIYLDEQAAKEFVEWLLKGGPSSGAPPPS

SEQ ID NO: 1060 - protein, 39 aa, Artificial sequence
  Synthetic polypeptide
  MISC_FEATURE: Analog 158
  MOD_RES (2)..(2): Xaa is Aib
  MISC_FEATURE (16)..(20): Lactam bridge between residues 16 and 20
YXQGTFTSDYSIYLDEQAAKEFVCWLLAGGPSSGAPPPS

SEQ ID NO: 1061 - protein, 39 aa, Artificial sequence
  Synthetic polypeptide
  MISC_FEATURE: Analog 162
  MOD_RES (2)..(2): Xaa is Aib
  MISC_FEATURE (16)..(20): Lactam bridge between residues 16 and 20
YXQGTFTSDYSYYLDEQAVKEFVNWLIAGGPSSGAPPPS

SEQ ID NO: 1062 - protein, 29 aa, Artificial sequence
  Synthetic polypeptide
  MISC_FEATURE: Analog 163
  MISC_FEATURE (16)..(20): Lactam bridge between residues 16 and 20
YSQGTFTSDYSIYLDEQAAKEFVNWLLAG

SEQ ID NO: 1063 - protein, 29 aa, Artificial sequence
  Synthetic polypeptide
  MISC_FEATURE: Analog 164
  MOD_RES (2)..(2): Xaa is Aib
  MISC_FEATURE (16)..(20): Lactam bridge between residues 16 and 20
YXQGTFTSDYSIYLDEQAAKEFVNWLLAG

SEQ ID NO: 1064 - protein, 40 aa, Artificial sequence
  Synthetic polypeptide
  MISC_FEATURE: Analog 165
  MOD_RES (2)..(2): Xaa is Aib
  MISC_FEATURE (16)..(20): Lactam bridge between residues 16 and 20
YXQGTFTSDYSIYLDEQAAKEFVNWLLAGGPSSGAPPPSC

SEQ ID NO: 1065 - protein, 40 aa, Artificial sequence; identical to SEQ ID NO: 1064
  Synthetic polypeptide
  MISC_FEATURE: Analog 166
  MOD_RES (2)..(2): Xaa is d-alanine
  MISC_FEATURE (16)..(20): Lactam bridge between residues 16 and 20

SEQ ID NO: 1066 - protein, 39 aa, Artificial sequence
  Synthetic polypeptide
  MISC_FEATURE: Analog 167
  MISC_FEATURE (17)..(20): Lactam bridge between residues 17 and 20
YSQGTFTSDYSIYLDEEAAKEFVNWLLAGGPSSGAPPPS

SEQ ID NO: 1067 - protein, 39 aa, Artificial sequence
  Synthetic polypeptide
  MISC_FEATURE: Analog 168
  MISC_FEATURE (18)..(21): Lactam bridge between residues 18 and 21
YSQGTFTSDYSIYLDEQKAKEFVNWLLAGGPSSGAPPPS

SEQ ID NO: 1068 - protein, 29 aa, Artificial sequence
  Synthetic polypeptide
  MISC_FEATURE: Analog 169
  MOD_RES (2)..(2): Xaa is Aib
  MISC_FEATURE (16)..(20): Lactam bridge between residues 16 and 20
YXQGTFTSDYSIYLDEQAAKEFVCWLLAG

SEQ ID NO: 1069 - protein, 40 aa, Artificial sequence; identical to SEQ ID NO: 1064
  Synthetic polypeptide
  MISC_FEATURE: Analog 170
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 1070 - protein, 29 aa, Artificial sequence
  Synthetic polypeptide
  MISC_FEATURE: Analog 172
  MOD_RES (2)..(2): Xaa is Aib
  MISC_FEATURE (16)..(20): Lactam bridge between residues 16 and 20
  MISC_FEATURE (24)..(24): PEG (40kDa) covalently attached to Cysteine
YXQGTFTSDYSIYLDEQAAKEFVCWLLAG

SEQ ID NO: 1071 - protein, 40 aa, Artificial sequence; identical to SEQ ID NO: 761
  Synthetic polypeptide
  MISC_FEATURE: Analog 174
  MOD_RES (2)..(2): Xaa is Aib
  MISC_FEATURE (16)..(20): Lactam bridge between residues 16 and 20

SEQ ID NO: 1072 - protein, 39 aa, Artificial sequence; identical to SEQ ID NO: 1060
  Synthetic polypeptide
  MISC_FEATURE: Analog 175
  MOD_RES (2)..(2): Xaa is Aib
  MISC_FEATURE (16)..(20): Lactam bridge between residues 16 and 20
  MISC_FEATURE (24)..(24): PEG (40kDa) covalently attached to Cysteine

SEQ ID NO: 1073 - protein, 40 aa, Artificial sequence
  Synthetic polypeptide
  MISC_FEATURE: Analog 176
  MOD_RES (2)..(2): Xaa is Aib
  MISC_FEATURE (16)..(20): Lactam bridge between residues 16 and 20
YXQGTFISDYSIYLDEQAAKEFVNWLLAGGPSSGAPPPSC

SEQ ID NO: 1074 - protein, 29 aa, Artificial sequence
  Synthetic polypeptide
  MISC_FEATURE: Analog 177
  MOD_RES (2)..(2): Xaa is Aib
  MISC_FEATURE (16)..(20): Lactam bridge between residues 16 and 20
YXQGTFISDYSIYLDEQAAKEFVCWLLAG

SEQ ID NO: 1075 - protein, 40 aa, Artificial sequence; identical to SEQ ID NO: 761
  Synthetic polypeptide
  MISC_FEATURE: Analog 178
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 1076 - protein, 29 aa, Artificial sequence
  Synthetic polypeptide
  MISC_FEATURE: Analog 179
  MOD_RES (2)..(2): Xaa is Aib
  MISC_FEATURE (16)..(20): Lactam bridge between residues 16 and 20
  MISC_FEATURE (24)..(24): PEG (40kDa) covalently attached to Cysteine
YXQGTFISDYSIYLDEQAAKEFVCWLLAG

SEQ ID NO: 1077 - protein, 40 aa, Artificial sequence; identical to SEQ ID NO: 1073
  Synthetic polypeptide
  MISC_FEATURE: Analog 182
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 1078 - protein, 29 aa, Artificial sequence
  Synthetic polypeptide
  MISC_FEATURE: Analog 186
  MOD_RES (2)..(2): Xaa is Aib
  MISC_FEATURE (16)..(20): Lactam bridge between residues 16 and 20
  MISC_FEATURE (24)..(24): PEG (40kDa) covalently attached to Cysteine
YXQGTFTSDYSIYLDEQAAKEFVCWLMNG

SEQ ID NO: 1079 - protein, 39 aa, Artificial sequence; identical to SEQ ID NO: 1055
  Synthetic polypeptide
  MISC_FEATURE: Analog 191
  MOD_RES (2)..(2): Xaa is Aib

SEQ ID NO: 1080 - protein, 34 aa, Artificial sequence
  Synthetic polypeptide
  MISC_FEATURE: Analog 192
FTSDYSIYLDEQAAKEFVNWLLAGGPSSGAPPPS

SEQ ID NO: 1081 - protein, 38 aa, Artificial sequence
  Synthetic polypeptide
  MISC_FEATURE: Analog 194
  MOD_RES (1)..(1): Xaa is Aib
XQGTFTSDYSIYLDEEAVRLFVNWLLAGGPSSGAPPPS

SEQ ID NO: 1082 - protein, 26 aa, Artificial sequence
  Synthetic polypeptide
  MISC_FEATURE: Analog 197
  MISC_FEATURE (13)..(17): Lactam bridge between residues 13 and 17
GTFTSDYSIYLDEQAAKEFVNWLLAG

SEQ ID NO: 1083 - protein, 28 aa, Artificial sequence
  Synthetic polypeptide
  MISC_FEATURE: Analog 198
  MOD_RES (1)..(1): Xaa is Aib
  MISC_FEATURE (15)..(19): Lactam bridge between residues 15 and 19
XQGTFTSDYSIYLDEQAAKEFVNWLLAG

SEQ ID NO: 1084 - protein, 40 aa, Artificial sequence
  Synthetic polypeptide
  MISC_FEATURE: Analog 199
  MOD_RES (2)..(2): Xaa is Aib
  MISC_FEATURE (16)..(20): Lactam bridge between residues 16 and 20
YXQGTFVSDYSIYLDEQAAKEFVNWLLAGGPSSGAPPPSC

SEQ ID NO: 1085 - protein, 40 aa, Artificial sequence
  Synthetic polypeptide
  MISC_FEATURE: Analog 200
  MOD_RES (2)..(2): Xaa is Aib
  MISC_FEATURE (16)..(20): Lactam bridge between residues 16 and 20
  MOD_RES (27)..(27): Xaa is Nle
YXQGTFTSDYSIYLDEQAAKEFVNWLXAGGPSSGAPPPSC

SEQ ID NO: 1086 - protein, 39 aa, Artificial sequence
  Synthetic polypeptide
  MISC_FEATURE: Analog 201
  MOD_RES (2)..(2): Xaa is Aib
YXQGTFTSDYSIYLDEEAVRLFVNWLLAGGPSSGAPPPS

SEQ ID NO: 1087 - protein, 40 aa, Artificial sequence; identical to SEQ ID NO: 1084
  Synthetic polypeptide
  MISC_FEATURE: Analog 202
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 1088 - protein, 40 aa, Artificial sequence; identical to SEQ ID NO: 1085
  Synthetic polypeptide
  MISC_FEATURE: Analog 203
  MOD_RES (2)..(2): Xaa is Aib
  MISC_FEATURE (16)..(20): Lactam bridge between residues 16 and 20
  MOD_RES (27)..(27): Xaa is Nle
  MISC_FEATURE (40)..(40): PEG (40kDa) covalently attached to Cysteine

SEQ ID NO: 1089 - protein, 40 aa, Artificial sequence
  Synthetic polypeptide
  MISC_FEATURE: Analog 204
  MOD_RES (2)..(2): Xaa is Aib
  MISC_FEATURE (16)..(20): Lactam bridge between residues 16 and 20
YXEGTFTSDYSIYLDEQAAKEFVNWLLAGRPSSGAPPPSC

SEQ ID NO: 1090 - protein, 40 aa, Artificial sequence; identical to SEQ ID NO: 1089
  Synthetic polypeptide
  MISC_FEATURE: Analog 205
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 1091 - protein, 43 aa, Artificial sequence
  Synthetic polypeptide
  MISC_FEATURE: Analog 206
  MOD_RES (2)..(2): Xaa is Aib
  MISC_FEATURE (16)..(20): Lactam bridge between residues 16 and 20
YXEGTFTSDYSIYLDEQAAKEFVNWLLAGKGKKNWLKHNITQC

SEQ ID NO: 1092 - protein, 43 aa, Artificial sequence
  Synthetic polypeptide
  MISC_FEATURE: Analog 207
  MOD_RES (2)..(2): Xaa is Aib
  MISC_FEATURE (16)..(20): Lactam bridge between residues 16 and 20
YXQGTFTSDYSIYLDEQAAKEFVNWLLAGKGKKNWLKHNITQC

SEQ ID NO: 1093 - protein, 43 aa, Artificial sequence; identical to SEQ ID NO: 1091
  Synthetic polypeptide
  MISC_FEATURE: Analog 208
  MOD_RES (2)..(2): Xaa is Aib
  MISC_FEATURE (16)..(20): Lactam bridge between residues 16 and 20
  MISC_FEATURE (43)..(43): PEG (40kDa) covalently attached to Cysteine

SEQ ID NO: 1094 - protein, 40 aa, Artificial sequence
  Synthetic polypeptide
  MISC_FEATURE: Analog 209
  MOD_RES (2)..(2): Xaa is Aib
  MISC_FEATURE (9)..(12): Lactam bridge between residues 9 and 12
  MISC_FEATURE (16)..(20): Lactam bridge between residues 16 and 20
YXQGTFTSEYSKYLDEQAAKEFVNWLLAGGPSSGAPPPSC

SEQ ID NO: 1095 - protein, 10 aa, Artificial sequence
  Synthetic polypeptide
  MISC_FEATURE: CEX
GPSSGAPPPS

SEQ ID NO: 1096 - protein, 11 aa, Artificial sequence
  Synthetic polypeptide
  MISC_FEATURE (1)..(1): Xaa is any amino acid
XGPSSGAPPPS

SEQ ID NO: 1097 - protein, 8 aa, Artificial sequence
  Synthetic polypeptide
KRNRNNIA

SEQ ID NO: 1098 - protein, 4 aa, Artificial sequence
  Synthetic polypeptide
KRNR

SEQ ID NO: 1099 - protein, 40 aa, Artificial Sequence; identical to SEQ ID NO: 760
  Synthetic polypeptide
  MOD_RES (2)..(2): Xaa is Aib
  MOD_RES (20)..(20): Xaa is Aib
  MISC_FEATURE (40)..(40): PEG (40kDa) covalently attached to Cysteine
  MISC_FEATURE (40)..(40): C-terminal amidation

SEQ ID NO: 1100 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): C-terminal amidation

SEQ ID NO: 1101 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 16 Carbon fatty acyl group covalently attached to Lysine
  MISC_FEATURE (40)..(40): C-terminal amidation

SEQ ID NO: 1102 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 14 Carbon fatty acyl group covalently attached Lysine
  MISC_FEATURE (40)..(40): C-terminal amidation

SEQ ID NO: 1103 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 18 Carbon fatty acyl group covalently attached to Lysine
  MISC_FEATURE (40)..(40): C-terminal amidation

SEQ ID NO: 1104 - protein, 40 aa, Artificial Sequence; identical to SEQ ID NO: 756
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (40)..(40): C-terminal amidation

SEQ ID NO: 1105 - protein, 40 aa, Artificial Sequence; identical to SEQ ID NO: 756
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently attached Lysine
  MISC_FEATURE (40)..(40): C-terminal amidation

SEQ ID NO: 1106 - protein, 40 aa, Artificial Sequence; identical to SEQ ID NO: 756
  Synthetic polypeptide
  MOD_RES (2)..(2): Xaa is Aib
  MOD_RES (20)..(20): Xaa is Aib
  MISC_FEATURE (40)..(40): 18 Carbon fatty acyl group covalently attached to Lysine
  MISC_FEATURE (40)..(40): C-terminal amidation

SEQ ID NO: 1107 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): C-terminal amidation
YXQGTFTSDYSIYLDKQAAXEFVNWLLAGGPSSGAPPPSC

SEQ ID NO: 1108 - protein, 40 aa, Artificial Sequence; identical to SEQ ID NO: 1107
  Synthetic polypeptide
  MOD_RES (2)..(2): Xaa is Aib
  MOD_RES (20)..(20): Xaa is Aib
  MISC_FEATURE (40)..(40): PEG (40kDa) attached to Cysteine
  MISC_FEATURE (40)..(40): C-terminal amidation

SEQ ID NO: 1109 - protein, 40 aa, Artificial Sequence; identical to SEQ ID NO: 760
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1110 - protein, 29 aa, Artificial Sequence
  Synthetic polypeptide
  MOD_RES (2)..(2): Xaa is Aib
  MOD_RES (20)..(20): Xaa is Aib
  MISC_FEATURE (29)..(29): C-terminal amidation
YXQGTFTSDYSIYLDKQAAXEFVCWLLAG

SEQ ID NO: 1111 - protein, 40 aa, Artificial Sequence; identical to SEQ ID NO: 756
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1112 - protein, 29 aa, Artificial Sequence
  Synthetic polypeptide
  MISC_FEATURE (2)..(2): Xaa is Aib
  MISC_FEATURE (20)..(20): Xaa is Aib
YXQGTFTSDYSIYLDKQAAXEFVNWLLAG

SEQ ID NO: 1113 - protein, 39 aa, Artificial Sequence
  Synthetic polypeptide
  MOD_RES (2)..(2): Xaa is Aib
  MOD_RES (20)..(20): Xaa is Aib
  MISC_FEATURE (24)..(24): 14 Carbon fatty acyl group covalently attached to Lysine
  MISC_FEATURE (39)..(39): C-terminal amidation
YXEGTFTSDYSIYLDKQAAXEFVKWLLAGGPSSGAPPPS

SEQ ID NO: 1114 - protein, 39 aa, Artificial Sequence; identical to SEQ ID NO: 1113
  Synthetic polypeptide
  MOD_RES (2)..(2): Xaa is Aib
  MOD_RES (20)..(20): Xaa is Aib
  MISC_FEATURE (24)..(24): 16 Carbon fatty acyl group covalently attached to Lysine
  MISC_FEATURE (39)..(39): C-terminal amidation

SEQ ID NO: 1115 - protein, 39 aa, Artificial Sequence; identical to SEQ ID NO: 1113
  Synthetic polypeptide
  MOD_RES (2)..(2): Xaa is Aib
  MOD_RES (20)..(20): Xaa is Aib
  MISC_FEATURE (24)..(24): 18 Carbon fatty acyl group covalently attached to Lysine
  MISC_FEATURE (39)..(39): C-terminal amidation

SEQ ID NO: 1116 - protein, 39 aa, Artificial Sequence; identical to SEQ ID NO: 1113
  Synthetic polypeptide
  MOD_RES (2)..(2): Xaa is Aib
  MOD_RES (20)..(20): Xaa is Aib
  MISC_FEATURE (39)..(39): C-terminal amidation

SEQ ID NO: 1117 - protein, 39 aa, Artificial Sequence; identical to SEQ ID NO: 758
  Synthetic polypeptide
  MOD_RES (2)..(2): Xaa is Aib
  MISC_FEATURE (10)..(10): 14 Carbon fatty acyl group covalently attached to Lysine
  MOD_RES (20)..(20): Xaa is Aib
  MISC_FEATURE (39)..(39): C-terminal amidation

SEQ ID NO: 1118 - protein, 39 aa, Artificial Sequence; identical to SEQ ID NO: 758
  Synthetic polypeptide
  MOD_RES (2)..(2): Xaa is Aib
  MISC_FEATURE (10)..(10): 16 Carbon fatty acyl group covalently attached to Lysine
  MOD_RES (20)..(20): Xaa is Aib
  MISC_FEATURE (39)..(39): C-terminal amidation

SEQ ID NO: 1119 - protein, 39 aa, Artificial Sequence; identical to SEQ ID NO: 758
  Synthetic polypeptide
  MOD_RES (2)..(2): Xaa is Aib
  MISC_FEATURE (10)..(10): 18 Carbon fatty acyl group covalently attached to Lysine
  MOD_RES (20)..(20): Xaa is Aib
  MISC_FEATURE (39)..(39): C-terminal amidation

SEQ ID NO: 1120 - protein, 39 aa, Artificial Sequence; identical to SEQ ID NO: 758
  Synthetic polypeptide
  MOD_RES (2)..(2): Xaa is Aib
  MOD_RES (20)..(20): Xaa is Aib
  MISC_FEATURE (39)..(39): C-terminal amidation

SEQ ID NO: 1121 - protein, 40 aa, Artificial Sequence
  Synthetic polypeptide
  MOD_RES (2)..(2): Xaa is Aib
  MOD_RES (16)..(16): Xaa is Orn
  MOD_RES (20)..(20): Xaa is Aib
  MISC_FEATURE (40)..(40): C-terminal amidation
YXQGTFTSDYSIYLDXQAAXEFVNWLLAGGPSSGAPPPSC

SEQ ID NO: 1122 - protein, 40 aa, Artificial Sequence; identical to SEQ ID NO: 1121
  Synthetic polypeptide
  MOD_RES (2)..(2): Xaa is Aib
  MOD_RES (16)..(16): Xaa is 2,4-diaminobutyric acid
  MOD_RES (20)..(20): Xaa is Aib
  MISC_FEATURE (40)..(40): C-terminal amidation

SEQ ID NO: 1123 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalentaly attached to Lysine
  MISC_FEATURE (40)..(40): C-terminal amidation
YXQGTFTSDYSIYLDKQAAXEFVNWLLAGGPSSGAPPPSK

SEQ ID NO: 1124 - protein, 40 aa, Artificial Sequence; identical to SEQ ID NO: 1123
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently attached to Lysine
  MISC_FEATURE (40)..(40): C-terminal amidation

SEQ ID NO: 1125 - protein, 40 aa, Artificial Sequence; identical to SEQ ID NO: 1123
  Synthetic polypeptide
  MOD_RES (2)..(2): Xaa is Aib
  MOD_RES (20)..(20): Xaa is Aib
  MISC_FEATURE (40)..(40): 18 Carbon fatty acyl group covalently attached to Lysine
  MISC_FEATURE (40)..(40): C-terminal amidation

SEQ ID NO: 1126 - protein, 40 aa, Artificial Sequence; identical to SEQ ID NO: 1123
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1127 - protein, 29 aa, Artificial Sequence
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (29)..(29): C-terminal amidation
YXQGTFTSDYSIYLDKQAAXEFVCWLLAG

SEQ ID NO: 1128 - protein, 29 aa, Artificial Sequence
  Synthetic polypeptide
  MOD_RES (2)..(2): Xaa is Aib
  MISC_FEATURE (10)..(10): 14 Carbon fatty acyl group covalently attached to Lysine
  MOD_RES (20)..(20): Xaa is Aib
  MISC_FEATURE (29)..(29): C-terminal amidation
YXEGTFTSDKSIYLDKQAAXEFVNWLLAG

SEQ ID NO: 1129 - protein, 29 aa, Artificial Sequence
  Synthetic polypeptide
  MOD_RES (2)..(2): Xaa is Aib
  MISC_FEATURE (10)..(10): 16 Carbon fatty acyl group covalently attached to Lysine
  MOD_RES (20)..(20): Xaa is Aib
  MISC_FEATURE (29)..(29): C-terminal amidation
YXEGTFTSDKSIYLDKQAAXEFVNWLLAG

SEQ ID NO: 1130 - protein, 29 aa, Artificial Sequence
  Synthetic polypeptide
  MOD_RES (2)..(2): Xaa is Aib
  MISC_FEATURE (10)..(10): 18 Carbon fatty acyl group covalently attached to Lysine
  MOD_RES (20)..(20): Xaa is Aib
  MISC_FEATURE (29)..(29): C-terminal amidation
YXEGTFTSDKSIYLDKQAAXEFVNWLLAG

SEQ ID NO: 1131 - protein, 29 aa, Artificial Sequence
  Synthetic polypeptide
  MOD_RES (2)..(2): Xaa is Aib
  MOD_RES (20)..(20): Xaa is Aib
  MISC_FEATURE (29)..(29): C-terminal amidation
YXEGTFTSDKSIYLDKQAAXEFVNWLLAG

SEQ ID NO: 1132 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (40)..(40): C-terminal amidation

SEQ ID NO: 1133 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently attached to Lysine
  MISC_FEATURE (40)..(40): C-terminal amidation

SEQ ID NO: 1134 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (40)..(40): 18 Carbon fatty acyl group covalently attached to Lysine
  MISC_FEATURE (40)..(40): C-terminal amidation

SEQ ID NO: 1135 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1136 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 14 Carbon fatty acyl group covalently attached to Lysine
  MISC_FEATURE (40)..(40): C-terminal amidation

SEQ ID NO: 1137 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 16 Carbon fatty acyl group covalently attached to Lysine
  MISC_FEATURE (40)..(40): C-terminal amidation

SEQ ID NO: 1138 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 18 Carbon fatty acyl group covalently attached to Lysine
  MISC_FEATURE (40)..(40): C-terminal amidation

SEQ ID NO: 1139 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): C-terminal amidation

SEQ ID NO: 1140 - protein, 40 aa, Artificial Sequence; identical to SEQ ID NO: 760
  Synthetic polypeptide
  MOD_RES (2)..(2): Xaa is Aib
  MOD_RES (20)..(20): Xaa is Aib
  MISC_FEATURE (40)..(40): PEG (40kDa) covalently attached to Cysteine
  MISC_FEATURE (40)..(40): C-terminal amidation

SEQ ID NO: 1141 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently attached to Lysine
  MISC_FEATURE (40)..(40): C-terminal amidation

SEQ ID NO: 1142 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently attached to Lysine
  MISC_FEATURE (40)..(40): C-terminal amidation
YXQGTFTSDYSIYLDKQAAXEFVCWLMNGGPSSGAPPPSK

SEQ ID NO: 1143 - protein, 40 aa, Artificial Sequence; identical to SEQ ID NO: 1142
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 16 Carbon fatty acyl group covalently attached to Lysine
  MISC_FEATURE (40)..(40): C-terminal amidation

SEQ ID NO: 1144 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (40)..(40): C-terminal amidation

SEQ ID NO: 1145 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (40)..(40): 18 Carbon fatty acyl group covalently attached to Lysine
  MISC_FEATURE (40)..(40): C-terminal amidation

SEQ ID NO: 1146 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1147 - protein, 40 aa, Artificial Sequence; identical to SEQ ID NO: 756
  Synthetic polypeptide
  MOD_RES (2)..(2): Xaa is Aib
  MOD_RES (20)..(20): Xaa is Aib
  MISC_FEATURE (40)..(40): 3-SH-propionic acyl group covalently attached to Lysine
  MISC_FEATURE (40)..(40): C-terminal amidation

SEQ ID NO: 1148 - protein, 40 aa, Artificial Sequence; identical to SEQ ID NO: 1123
  Synthetic polypeptide
  MOD_RES (2)..(2): Xaa is Aib
  MOD_RES (20)..(20): Xaa is Aib
  MISC_FEATURE (40)..(40): 8 Carbon fatty acyl group covalently attached to Lysine
  MISC_FEATURE (40)..(40): C-terminal amidation

SEQ ID NO: 1149 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): C-terminal amidation
YXQGTFSSDYSIYLDKQAAXEFVNWLLAGGPSSGAPPPSC

SEQ ID NO: 1150 - protein, 40 aa, Artificial Sequence
  Synthetic polypeptide
  MOD_RES (2)..(2): Xaa is Aib
  MOD_RES (7)..(7): Xaa is 2-aminobutyric acid
  MOD_RES (20)..(20): Xaa is Aib
  MISC_FEATURE (40)..(40): C-terminal amidation
YXQGTFXSDYSIYLDKQAAXEFVNWLLAGGPSSGAPPPSC

SEQ ID NO: 1151 - protein, 40 aa, Artificial Sequence; identical to SEQ ID NO: 766
  Synthetic polypeptide
  MOD_RES (2)..(2): Xaa is Aib
  MOD_RES (20)..(20): Xaa is Aib
  MISC_FEATURE (40)..(40): 8 Carbon fatty acyl group covalently attached to Lysine
  MISC_FEATURE (40)..(40): C-terminal amidation

SEQ ID NO: 1152 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (40)..(40): 8 Carbon fatty acyl group covalently attached to Lysine
  MISC_FEATURE (40)..(40): C-terminal amidation

SEQ ID NO: 1153 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): C-terminal amidation

SEQ ID NO: 1154 - protein, 40 aa, Artificial Sequence
  Synthetic polypeptide
  MOD_RES (2)..(2): Xaa is Aib
  MOD_RES (20)..(20): Xaa is Aib
  MOD_RES (40)..(40): Xaa is d-Lysine
  MISC_FEATURE (40)..(40): 14 Carbon fatty acyl group covalently attached to d-Lysine
  MISC_FEATURE (40)..(40): C-terminal amidation
YXEGTFTSDYSIYLDKQAAXEFVCWLLAGGPSSGAPPPSX

SEQ ID NO: 1155 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MOD_RES (40)..(40): Xaa is d-Lysine
  MISC_FEATURE (40)..(40): C-terminal amidation

SEQ ID NO: 1156 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MOD_RES (40)..(40): Xaa is d-Lysine
  MISC_FEATURE (40)..(40): 14 Carbon fatty acyl group covalently attached to Lysine
  MISC_FEATURE (40)..(40): C-terminal amidation

SEQ ID NO: 1157 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): Xaa is d-Lysine
  MISC_FEATURE (40)..(40): C-terminal amidation

SEQ ID NO: 1158 - protein, 39 aa, Artificial Sequence
  Synthetic polypeptide
  MOD_RES (2)..(2): Xaa is Aib
  MISC_FEATURE (10)..(10): 14 Carbon fatty acyl group covalently attached to Lysine
  MOD_RES (20)..(20): Xaa is Aib
  MISC_FEATURE (40)..(40): C-terminal amidation
YXEGTFTSDKSIYLDKQAAXEFVCWLLAGGPSSGAPPPS

SEQ ID NO: 1159 - protein, 39 aa, Artificial Sequence; identical to SEQ ID NO: 1158
  Synthetic polypeptide
  MOD_RES (2)..(2): Xaa is Aib
  MOD_RES (20)..(20): Xaa is Aib
  MISC_FEATURE (40)..(40): C-terminal amidation

SEQ ID NO: 1160 - protein, 41 aa, Artificial Sequence
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (41)..(41): C-terminal amidation
YXEGTFTSDYSIYLDKQAAXEFVNWLLAGGPSSGAPPPSKC

SEQ ID NO: 1161 - protein, 41 aa, Artificial Sequence; identical to SEQ ID NO: 1160
  Synthetic polypeptide
  MOD_RES (2)..(2): Xaa is Aib
  MOD_RES (20)..(20): Xaa is Aib
  MISC_FEATURE (41)..(41): C-terminal amidation

SEQ ID NO: 1162 - protein, 39 aa, Artificial Sequence; identical to SEQ ID NO: 1158
  Synthetic polypeptide
  MOD_RES (2)..(2): Xaa is Aib
  MISC_FEATURE (10)..(10): 14 Carbon fatty acyl group covalently attached to Lysine
  MOD_RES (20)..(20): Xaa is Aib
  MISC_FEATURE (24)..(24): PEG (40kDa) covalently attached to Cysteine
  MISC_FEATURE (39)..(39): C-terminal amidation

SEQ ID NO: 1163 - protein, 41 aa, Artificial Sequence; identical to SEQ ID NO: 1160
  Synthetic polypeptide
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (41)..(41): PEG (40kDa) covalently attached to Cysteine
  MISC_FEATURE (41)..(41): C-terminal amidation

SEQ ID NO: 1164 - protein, 41 aa, Artificial Sequence; identical to SEQ ID NO: 1160
  Synthetic polypeptide
  MOD_RES (2)..(2): Xaa is Aib
  MOD_RES (20)..(20): Xaa is Aib
  MISC_FEATURE (41)..(41): PEG (40kDa) covalently attached to Cysteine
  MISC_FEATURE (41)..(41): C-terminal amidation

SEQ ID NO: 1165 - protein, 40 aa, Artificial Sequence
  Synthetic polypeptide
  MOD_RES (2)..(2): Xaa is Aib
  MISC_FEATURE (40)..(40): 14 Carbon fatty acyl group covalently attached to Lysine
  MISC_FEATURE (40)..(40): C-terminal amidation
HXQGTFTSDYSKYLDEQAAKEFICWLMNGGPSSGAPPPSK

SEQ ID NO: 1166 - protein, 40 aa, Artificial Sequence; identical to SEQ ID NO: 759
  Synthetic polypeptide
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 14 Carbon fatty acyl group covalently attached to Lysine
  MISC_FEATURE (40)..(40): C-terminal amidation

SEQ ID NO: 1167 - protein, 40 aa, Artificial Sequence
  Synthetic polypeptide
  MOD_RES (2)..(2): Xaa is Aib
  MOD_RES (16)..(16): Xaa is Aib
  MISC_FEATURE (40)..(40): C-terminal amidation
YXQGTFTSDYSIYLDXQAAKEFVNWLLAGGPSSGAPPPSC

SEQ ID NO: 1168 - protein, 40 aa, Artificial Sequence
  Synthetic polypeptide
  MOD_RES (2)..(2): Xaa is Aib
  MOD_RES (16)..(16): Xaa is Aib
  MISC_FEATURE (40)..(40): C-terminal amidation
YXQGTFTSDYSIYLDXQAAQEFVNWLLAGGPSSGAPPPSC

SEQ ID NO: 1169 - protein, 40 aa, Artificial Sequence
  Synthetic polypeptide
  MOD_RES (2)..(2): Xaa is Aib
  MOD_RES (12)..(16): Lactam bridge between residues 12 and 16
  MOD_RES (20)..(20): Xaa is Aib
  MOD_RES (40)..(40): C-terminal amidation
YXQGTFTSDYSKYLDEQAAXEFVNWLLAGGPSSGAPPPSC

SEQ ID NO: 1170 - protein, 10 aa, Artificial Sequence
  Synthetic polypeptide
GPSSGAPPPK

SEQ ID NO: 1171 - protein, 11 aa, Artificial Sequence
  Synthetic polypeptide
  MOD_RES (1)..(1): Xaa is Gly or a small, aliphatic or non-polar or slightly polar amino acid
XGPSSGAPPPK

SEQ ID NO: 1172 - protein, 12 aa, Artificial Sequence
  Synthetic  polypeptide
  MOD_RES (1)..(1): Xaa is Gly or a small, aliphatic or non-polar or slightly polar amino acid
XGPSSGAPPPSK

SEQ ID NO: 1173 - protein, 40 aa, Artificial Sequence; identical to SEQ ID NO: 1167
  Synethic polypeptide
  MOD_RES (2)..(2): Xaa is Aib
  MOD_RES (16)..(16): Xaa is Aib
  MISC_FEATURE (40)..(40): PEG (40kDa) covalently attached to Cysteine
  MISC_FEATURE (40)..(40): C-terminal amidation

SEQ ID NO: 1174 - protein, 40 aa, Artificial Sequence; identical to SEQ ID NO: 1168
  Synthetic polypeptide
  MOD_RES (2)..(2): Xaa is Aib
  MOD_RES (16)..(16): Xaa is Aib
  MISC_FEATURE (40)..(40): PEG (40kDa) covalently attached to Cysteine
  MISC_FEATURE (40)..(40): C-terminal amidation

SEQ ID NO: 1175 - protein, 40 aa, Artificial Sequence; identical to SEQ ID NO: 1121
  Synthetic polypeptide
  MOD_RES (2)..(2): Xaa is Aib
  MOD_RES (16)..(16): Xaa is Aib
  MOD_RES (20)..(20): Xaa is Aib
  MISC_FEATURE (40)..(40): C-terminal amidation

SEQ ID NO: 1176 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): C-terminal amidation
YXQGTFTSDYSIYLDEQAAXEFVNWLLAGGPSSGAPPPSC

SEQ ID NO: 1177 - protein, 29 aa, Artificial Sequence
  Synthetic polypeptide
  MOD_RES (2)..(2): Xaa is Aib
  MOD_RES (20)..(20): Xaa is Aib
  MISC_FEATURE (29)..(29): C-terminal amidation
YXQGTFTSDYSIYLDEQAAXEFVCWLLAG

SEQ ID NO: 1178 - protein, 29 aa, Artificial Sequence
  Synthetic polypeptide
  MISC_FEATURE: C-terminal amidation
  MOD_RES (2)..(2): Xaa is Aib
  MOD_RES (20)..(20): Xaa is Aib
YXQGTFTSDYSIYLDSQAAXEFVCWLLAG

SEQ ID NO: 1179 - protein, 30 aa, Artificial Sequene
  Synthetic polypeptide
  MOD_RES (2)..(2): Xaa is Aib
  MISC_FEATURE (24)..(24): PEG (40kDa) covalently attached to Cysteine
HXEGTFTSDVSSYLEEQAAKEFICWLVKGR

SEQ ID NO: 1180 - protein, 42 aa, Artificial Sequence
  Synthetic polypeptide
  MISC_FEATURE (24)..(24): Substituted amino acid covalently linked to hydrophilic group
YAPGTFISDYSIAMDKIHQQDFVXWLLAQKGKKNWLKHNITQ

SEQ ID NO: 1181 - protein, 40 aa, Artificial Sequence
  Synthetic polypeptide
  MOD_RES (2)..(2): Xaa is Aib
  MISC_FEATURE (16)..(20): Lactam bridge between residues 16 and 20
  MISC_FEATURE (40)..(40): Substituted amino acid covalentaly linked to hydrophilic group
YXQGTFTSDYSIYLDEQAAKEFVNWLLAGGPSSGAPPPSX

SEQ ID NO: 1182 - protein, 29 aa, Artificial Sequence
  Synthetic polypeptide
  MOD_RES (2)..(2): Xaa is Aib
  MISC_FEATURE (16)..(20): Lactam bridge between residues 16 and 20
  MISC_FEATURE (24)..(24): Substituted amino acid covalently linked to hydrophilic group
  misc_feature (29)..(29): Xaa can be any naturally occurring amino acid
YXQGTFTSDYSIYLDEQAAKEFVXWLLAX

SEQ ID NO: 1183 - protein, 39 aa, Artificial Sequence
  Synthetic polypeptide
  MOD_RES (2)..(2): Xaa is Aib
  MISC_FEATURE (16)..(20): Lactam bridge between residues 16 and 20
  MISC_FEATURE (24)..(24): Substituted amino acid covalently linked to hydrophilic group
YXQGTFTSDYSIYLDEQAAKEFVXWLLAGGPSSGAPPPS

SEQ ID NO: 1184 - protein, 40 aa, Artificial Sequence
  Synthetic polypeptide
  MOD_RES (2)..(2): Xaa is Aib
  MISC_FEATURE (16)..(20): Lactam bridge between residues 16 and 20
  MISC_FEATURE (40)..(40): Substituted amino acid covalently linked to hydrophilic group
YXEGTFTSDYSIYLDEQAAKEFVNWLLAGGPSSGAPPPSX

SEQ ID NO: 1185 - protein, 29 aa, Artificial Sequence
  Sythetic polypeptide
  MOD_RES (2)..(2): Xaa is Aib
  MISC_FEATURE (16)..(20): Lactam bridge between residues 16 and 20
  MISC_FEATURE (24)..(24): Substituted amino acid covalently linked to hydrophilic group
YXQGTFISDYSIYLDEQAAKEFVXWLLAG

SEQ ID NO: 1186 - protein, 40 aa, Artificial Sequence
  Synthetic polypeptide
  MOD_RES (2)..(2): Xaa is Aib
  MISC_FEATURE (16)..(20): Lactam bridge between residues 16 and 20
  MISC_FEATURE (40)..(40): Substituted amino acid covalently linked to hydrophilic group
YXQGTFISDYSIYLDEQAAKEFVNWLLAGGPSSGAPPPSX

SEQ ID NO: 1187 - protein, 29 aa, Artificial sequence
  Synthetic polypeptide
  MOD_RES (2)..(2): Xaa is Aib
  MISC_FEATURE (16)..(20): Lactam bridge between residues 16 and 20
  MISC_FEATURE (24)..(24): Substituted amino acid covalently linked to hydrophilic group
YXQGTFTSDYSIYLDEQAAKEFVXWLMNG

SEQ ID NO: 1188 - protein, 40 aa, Artificial sequence
  Synthetic polypeptide
  MOD_RES (2)..(2): Xaa is Aib
  MISC_FEATURE (16)..(20): Lactam bridge between residues 16 and 20
  MISC_FEATURE (40)..(40): Substitute amino acid covalently linked to hydrophilic group
YXQGTFVSDYSIYLDEQAAKEFVNWLLAGGPSSGAPPPSX

SEQ ID NO: 1189 - protein, 40 aa, Artificial sequence
  Synthetic polypeptide
  MOD_RES (2)..(2): Xaa is Aib
  MISC_FEATURE (16)..(20): Lactam bridge between residues 16 and 20
  MOD_RES (27)..(27): Xaa is Nle
  MISC_FEATURE (40)..(40): Substituted amino acid covalently linked to hydrophilic group
YXQGTFTSDYSIYLDEQAAKEFVNWLXAGGPSSGAPPPSX

SEQ ID NO: 1190 - protein, 40 aa, Artificial sequence
  Synthetic polypeptide
  MOD_RES (2)..(2): Xaa is Aib
  MISC_FEATURE (16)..(20): Lactam bridge between residues 16 and 20
  MISC_FEATURE (40)..(40): Substituted amino acid covalently linked to hydrophilic group
YXEGTFTSDYSIYLDEQAAKEFVNWLLAGRPSSGAPPPSX

SEQ ID NO: 1191 - protein, 43 aa, Artificial sequence
  Synthetic polypeptide
  MOD_RES (2)..(2): Xaa is Aib
  MISC_FEATURE (16)..(20): Lactam bridge between residues 16 and 20
  MISC_FEATURE (43)..(43): Substituted amino acid covalently linked to hydrophilic group
YXEGTFTSDYSIYLDEQAAKEFVNWLLAGKGKKNWLKHNITQX

SEQ ID NO: 1192 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to hydrophilic group
  MISC_FEATURE (40)..(40): C-terminal amidation
YXEGTFTSDYSIYLDKQAAXEFVNWLLAGGPSSGAPPPSX

SEQ ID NO: 1193 - protein, 40 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): C-terminal amidation
YXEGTFTSDYSIYLDKQAAXEFVXWLLAGGPSSGAPPPSK

SEQ ID NO: 1194 - protein, 40 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substitute amino acid covalently linked to an acyl or alkyl group
  MISC_FEATURE (40)..(40): C-terminal amidation
YXEGTFTSDYSIYLDKQAAXEFVXWLLAGGPSSGAPPPSX

SEQ ID NO: 1195 - protein, 40 aa, Artificial Sequence; identical to SEQ ID NO: 1192
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to an acyl or alkyl group
  MISC_FEATURE (40)..(40): C-terminal amidation

SEQ ID NO: 1196 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to hydrophilic group
  MISC_FEATURE (40)..(40): C-terminal amidation
YXQGTFTSDYSIYLDKQAAXEFVNWLLAGGPSSGAPPPSX

SEQ ID NO: 1197 - protein, 39 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to acyl or alkyl group
  MISC_FEATURE (39)..(39): C-terminal amidation
YXEGTFTSDYSIYLDKQAAXEFVXWLLAGGPSSGAPPPS

SEQ ID NO: 1198 - protein, 39 aa, Artificial Sequence
  Synthetic polypeptide
  MOD_RES (2)..(2): Xaa is Aib
  MISC_FEATURE (10)..(10): Substituted amino acid covalently linked to acyl or alkyl group
  MOD_RES (20)..(20): Xaa is Aib
  MISC_FEATURE (39)..(39): C-terminal amidation
YXEGTFTSDXSIYLDKQAAXEFVNWLLAGGPSSGAPPPS

SEQ ID NO: 1199 - protein, 40 aa, Artificial Sequence; identical to SEQ ID NO: 1196
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1200 - protein, 29 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (29)..(29): C-terminal amidation
YXQGTFTSDYSIYLDKQAAXEFVXWLLAG

SEQ ID NO: 1201 - protein, 29 aa, Artificial Sequence
  Synthetic polypeptide
  MOD_RES (2)..(2): Xaa is Aib
  MISC_FEATURE (10)..(10): Substituted amino acid covalently linked to acyl or alkyl group
  MOD_RES (20)..(20): Xaa is Aib
  MISC_FEATURE (29)..(29): C-terminal amidation
YXEGTFTSDXSIYLDKQAAXEFVNWLLAG

SEQ ID NO: 1202 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked acyl or alkyl group
  MISC_FEATURE (40)..(40): C-terminal amidation
YXQGTFTSDYSIYLDKQAAXEFVCWLLAGGPSSGAPPPSX

SEQ ID NO: 1203 - protein, 40 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substituted amino acid covalently linked to acyl or alkyl group
  MISC_FEATURE (40)..(40): C-terminal amidation
YXQGTFTSDYSIYLDKQAAXEFVXWLLAGGPSSGAPPPSX

SEQ ID NO: 1204 - protein, 40 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): C-terminal amidation
YXQGTFTSDYSIYLDKQAAXEFVXWLLAGGPSSGAPPPSK

SEQ ID NO: 1205 - protein, 40 aa, Artificial Sequence; identical to SEQ ID NO: 1192
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to hydrophilic group
  MISC_FEATURE (40)..(40): C-terminal amidation

SEQ ID NO: 1206 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1207 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation
YXQGTFTSDYSIYLDKQAAXEFVCWLMNGGPSSGAPPPSX

SEQ ID NO: 1208 - protein, 40 aa, Artificial Sequence
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substituted amino acid covalently linked to acyl or alkyl group
  MISC_FEATURE (40)..(40): C-terminal amidation
YXQGTFTSDYSIYLDKQAAXEFVXWLMNGGPSSGAPPPSX

SEQ ID NO: 1209 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1210 - protein, 40 aa, Artificial Sequence; identical to SEQ ID NO: 1196
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1211 - protein, 40 aa, Artificial Sequence; identical to SEQ ID NO: 1202
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1212 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1213 - protein, 40 aa, Artificial Sequence; identical to SEQ ID NO: 1193
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): C-terminal amidation

SEQ ID NO: 1214 - protein, 40 aa, Artificial Sequence; identical to SEQ ID NO: 1154
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 1215 - protein, 40 aa, Artificial Sequence; identical to SEQ ID NO: 1194
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substituted amino acid covalently linked to acyl or alkyl group
  MISC_FEATURE (40)..(40): C-terminal amidation

SEQ ID NO: 1216 - protein, 40 aa, Artificial Sequence; identical to SEQ ID NO: 1194
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): C-terminal amidation

SEQ ID NO: 1217 - protein, 39 aa, Artificial Sequence
  Synthetic polypeptide
  MOD_RES (2)..(2): Xaa is Aib
  MISC_FEATURE (10)..(10): Substituted amino acid covalently linked to acyl or alkyl group
  MOD_RES (20)..(20): Xaa is Aib
  MISC_FEATURE (40)..(40): C-terminal amidation
YXEGTFTSDXSIYLDKQAAXEFVCWLLAGGPSSGAPPPS

SEQ ID NO: 1218 - protein, 41 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (41)..(41): C-terminal amidation
YXEGTFTSDYSIYLDKQAAXEFVNWLLAGGPSSGAPPPSXC

SEQ ID NO: 1219 - protein, 39 aa, Artificial Sequence
  Synthetic polypeptide
  MOD_RES (2)..(2): Xaa is Aib
  MISC_FEATURE (10)..(10): Substituted amino acid covalently linked to acyl or alkyl group
  MOD_RES (20)..(20): Xaa is Aib
  MISC_FEATURE (24)..(24): Substituted amino acid covalently linked to hydrophilic group
  MISC_FEATURE (39)..(39): C-terminal amidation
YXEGTFTSDXSIYLDKQAAXEFVXWLLAGGPSSGAPPPS

SEQ ID NO: 1220 - protein, 41 aa, Artificial Sequence
  Synthetic polypeptide
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (41)..(41): Substituted amino acid covalently linked to hydrophilic group
  MISC_FEATURE (41)..(41): C-terminal amidation
YXEGTFTSDYSIYLDKQAAXEFVNWLLAGGPSSGAPPPSXX

SEQ ID NO: 1221 - protein, 41 aa, Artificial Sequence
  Synthetic polypeptide
  MOD_RES (2)..(2): Xaa is Aib
  MOD_RES (20)..(20): Xaa is Aib
  MISC_FEATURE (41)..(41): Substituted amino acid covalently linked to hydrophilic group
  MISC_FEATURE (41)..(41): C-terminal amidation
YXEGTFTSDYSIYLDKQAAXEFVNWLLAGGPSSGAPPPSKX

SEQ ID NO: 1222 - protein, 40 aa, Artificial Sequence
  Synthetic polypeptide
  MOD_RES (2)..(2): Xaa is Aib
  MISC_FEATURE (40)..(40): Substituted amino acid covalently linked to acyl or alkyl group
  MISC_FEATURE (40)..(40): C-terminal amidation
HXQGTFTSDYSKYLDEQAAKEFICWLMNGGPSSGAPPPSX

SEQ ID NO: 1223 - protein, 40 aa, Artificial Sequence; identical to SEQ ID NO: 1194
  Synthetic polypeptide
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substituted amino acid covalently linked to acyl or alkyl group
  MISC_FEATURE (40)..(40): C-terminal amidation

SEQ ID NO: 1224 - protein, 40 aa, Artificial Sequence
  Synethic polypeptide
  MOD_RES (2)..(2): Xaa is Aib
  MOD_RES (16)..(16): Xaa is Aib
  MISC_FEATURE (40)..(40): Substituted amino acid covalently linked to hydrophilic group
  MISC_FEATURE (40)..(40): C-terminal amidation
YXQGTFTSDYSIYLDXQAAKEFVNWLLAGGPSSGAPPPSX

SEQ ID NO: 1225 - protein, 40 aa, Artificial Sequence
  Synthetic polypeptide
  MOD_RES (2)..(2): Xaa is Aib
  MOD_RES (16)..(16): Xaa is Aib
  MISC_FEATURE (40)..(40): Substituted amino acid covalently linked to hydrophilic group
  MISC_FEATURE (40)..(40): C-terminal amidation
YXQGTFTSDYSIYLDXQAAQEFVNWLLAGGPSSGAPPPSX

SEQ ID NO: 1226 - protein, 30 aa, Artificial Sequene; identical to SEQ ID NO: 1179
  Synthetic polypeptide
  MOD_RES (2)..(2): Xaa is Aib
  MISC_FEATURE (24)..(24): Substituted amino acid covalently linked to hydrophilic group

SEQ ID NO: 1227 - protein, 29 aa, Artificial Sequence
  Synthetic polypeptide
  MOD_RES (2)..(2): Xaa is Aib
  MOD_RES (20)..(20): Xaa is Aib
  MISC_FEATURE (29)..(29): C-terminal amidation
YXQGTFTSDYSIYLDKQAAXEFVNWLLAG

SEQ ID NO: 1228 - protein, 29 aa, Artificial Sequence
  Synthetic polypeptide
  MOD_RES (2)..(2): Xaa is D-Ser, D-Ala, Val, Gly, N-Methyl Ser, N-Methyl Ala, or Aib
  MOD_RES (16)..(16): Xaa is Lys, Glu, Ser, Orn, Dab, Aib or any alpha, alpha-disubstituted amino acid
  MOD_RES (20)..(20): Xaa is any alpha, alpha-disubstituted amino acid
  MOD_RES (27)..(27): Xaa is Ile, Leu, or Nle
  MOD_RES (28)..(28): Xaa is Ala or Gly
  MOD_RES (29)..(29): Xaa is Thr, Ala, or Gly
  MISC_FEATURE (29)..(29): C-terminal amidation
YXQGTFTSDYSIYLDXQAAXEFVNWLXXX

SEQ ID NO: 1229 - protein, 29 aa, Artificial Sequence
  Synthetic polypeptide
  MOD_RES (2)..(2): Xaa is Aib
  MOD_RES (20)..(20): Xaa is Aib
  MISC_FEATURE (29)..(29): C-terminal amidation
YXQGTFTSDYSKYLDKRRAXDFVQWLLAG

SEQ ID NO: 1230 - protein, 29 aa, Artificial Sequence
  Synthetic polypeptide
  MOD_RES (2)..(2): Xaa is D-Ser, DAla, Val, Gly, N-Methyl Ser, N-Methyl Ala, or Aib
  MOD_RES (16)..(16): Xaa is Lys, Glu, Ser, Orn, Dab, Aib or any alpha, alpha-disubstituted amino acid
  MOD_RES (20)..(20): Xaa is any alpha, alpha-disubstituted amino acid
  MOD_RES (27)..(27): Xaa is Ile, Leu, or Nle
  MOD_RES (28)..(28): Xaa is Ala or Gly
  MOD_RES (29)..(29): Xaa is Thr, Ala, or Gly
  MOD_RES (29)..(29): C-terminal amidation
YXQGTFTSDYSKYLDXRRAXDFVQWLXXX

SEQ ID NO: 1231 - protein, 41 aa, Artificial Sequence; identical to SEQ ID NO: 1160
  Synthetic polypeptide
  MISC_FEATURE: Homodimer
  MOD_RES (2)..(2): Xaa is Aib
  MOD_RES (20)..(20): Xaa is Aib
  MISC_FEATURE (40)..(40): 14 Carbon fatty acyl group covalently bound to Lysine
  MOD_RES (40)..(40): C-terminal amidation
  DISULFID (41)..(41): Disulfide bond formed with Cys residue of a second peptide having the same structure.

SEQ ID NO: 1232 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): C-terminal amidation
YXQGTFTSDYSIYLDKQAAXEFVNWLMNGGPSSGAPPPSK

SEQ ID NO: 1233 - protein, 40 aa, Artificial Sequence
  Synthetic polypeptide
  MOD_RES (2)..(2): Xaa is Aib
  MOD_RES (20)..(20): Xaa is Aib
  MISC_FEATURE (40)..(40): C-terminal amidation
YXQGTFISDYSIYLDKQAAXEFVNWLLAGGPSSGAPPPSK

SEQ ID NO: 1234 - protein, 40 aa, Artificial Sequence; identical to SEQ ID NO: 1233
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently bound to Lysine
  MISC_FEATURE (40)..(40): C-terminal amidation

SEQ ID NO: 1235 - protein, 40 aa, Artificial Sequence; identical to SEQ ID NO: 756
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently bound to Lysine via a dipeptide spacer
  MISC_FEATURE (40)..(40): C-terminal amidation

SEQ ID NO: 1236 - protein, 40 aa, Artificial Sequence; identical to SEQ ID NO: 1123
  Synthetic polypeptide
  MOD_RES (2)..(2): Xaa is Aib
  MOD_RES (20)..(20): Xaa is Aib
  MISC_FEATURE (40)..(40): 16 Carbon fatty acyl group covalently bound to Lysine via a dipeptide spacer
  MISC_FEATURE (40)..(40): C-terminal amidation

SEQ ID NO: 1237 - protein, 40 aa, Artificial Sequence; identical to SEQ ID NO: 765
  Synthetic polypeptide
  MOD_RES (2)..(2): Xaa is Aib
  MISC_FEATURE (10)..(10): 16 Carbon fatty acyl group covalently bound to Lysine via dipeptide spacer
  MOD_RES (20)..(20): Xaa is Aib
  MISC_FEATURE (40)..(40): C-terminal amidation

SEQ ID NO: 1238 - protein, 41 aa, Artificial Sequence; identical to SEQ ID NO: 1160
  Synthetic polypeptide
  MISC_FEATURE: Homodimer
  MOD_RES (2)..(2): Xaa is Aib
  MOD_RES (20)..(20): Xaa is Aib
  MISC_FEATURE (40)..(40): 14 Carbon fatty acyl group covelently bound to Lysine
  MISC_FEATURE (41)..(41): C-terminal amidation
  MISC_FEATURE (41)..(41): Cys residue covalently attached to 20 kDa PEG which is in turn covalently attached to a Cys residue of a second peptide having the same structure

SEQ ID NO: 1239 - protein, 41 aa, Artificial Sequence; identical to SEQ ID NO: 1160
  Synthetic polypeptide
  MISC_FEATURE: homodimer
  MOD_RES (2)..(2): Xaa is Aib
  MOD_RES (20)..(20): Xaa is Aib
  MISC_FEATURE (40)..(40): 14 Carbon fatty acyl group covalently bound to Lysine
  MISC_FEATURE (41)..(41): PEG (5kDa) covalently bound to Cysteine
  MISC_FEATURE (41)..(41): C-terminal amidation
  MISC_FEATURE (41)..(41): Cys residue covalently attached to 5 kDa PEG which is in turn covalently attached to a Cys residue of a second peptide having the same structure

SEQ ID NO: 1240 - protein, 29 aa, Artificial Sequence
  Synthetic polypeptide
  MOD_RES (3)..(3): Xaa is a Glutamine analog
  MOD_RES (27)..(27): Xaa is Nle
HSXGTFTSDYSKYLDTRRAAEFVAWLXDE

SEQ ID NO: 1241 - protein, 29 aa, Artificial Sequence
  Synthetic polypeptide
  MOD_RES (3)..(3): Xaa is a Glutamine analog
  MOD_RES (16)..(16): Xaa is Aib
HSXGTFTSDYSKYLDXRRAADFVAWLMDE

SEQ ID NO: 1242 - protein, 29 aa, Artificial Sequence
  Synthetic polypeptide
  MOD_RES (27)..(27): Xaa is Nle
HSQGTFTSDYSKYLDTRRAAEFVAWLXDE

SEQ ID NO: 1243 - protein, 29 aa, Artificial Sequence
  Synthetic peptide
  MOD_RES (3)..(3): Xaa is Acetamidomethyl-cysteine
  MOD_RES (27)..(27): Xaa is Nle
HSXGTFTSDYSKYLDTRRAAEFVAWLXDE

SEQ ID NO: 1244 - protein, 29 aa, Artificial Sequence
  Synthetic peptide
  MOD_RES (3)..(3): Xaa is Acetyldiaminobutanoic acid
  MOD_RES (27)..(27): Xaa is Nle
HSXGTFTSDYSKYLDTRRAAEFVAWLXDE

SEQ ID NO: 1245 - protein, 29 aa, Artificial Sequence
  Synthetic polypeptide
  MOD_RES (3)..(3): Xaa is carbamoyldiaminopropanoic acid
  MOD_RES (27)..(27): Xaa is Nle
HSXGTFTSDYSKYLDTRRAAEFVAWLXDE

SEQ ID NO: 1246 - protein, 29 aa, Artificial Sequence
  Synthetic polypeptide
  MOD_RES (3)..(3): Xaa is Methylglutamine
  MOD_RES (27)..(27): Xaa is Nle
HSXGTFTSDYSKYLDTRRAAEFVAWLXDE

SEQ ID NO: 1247 - protein, 29 aa, Artificial Sequence
  Synthetic peptide
  MOD_RES (3)..(3): Xaa is Methionine sulfoxide
  MOD_RES (27)..(27): Xaa is Nle
HSXGTFTSDYSKYLDTRRAAEFVAWLXDE

SEQ ID NO: 1248 - protein, 29 aa, Artificial Sequence
  Synthetic peptide
  MOD_RES (3)..(3): Xaa is Acetylornithine
  MOD_RES (27)..(27): Xaa is Nle
HSXGTFTSDYSKYLDTRRAAEFVAWLXDE

SEQ ID NO: 1249 - protein, 29 aa, Artificial Sequence
  Synthetic polypeptide
  MOD_RES (16)..(16): Xaa is Aib
HSQGTFTSDYSKYLDXRRAADFVAWLMDE

SEQ ID NO: 1250 - protein, 29 aa, Artificial Sequence
  Synthetic polypeptide
  MOD_RES (3)..(3): Xaa is Acetyldiaminobutanoic acid
  MOD_RES (16)..(16): Xaa is Aib
HSXGTFTSDYSKYLDXRRAADFVAWLMDE

SEQ ID NO: 1251 - protein, 29 aa, Artificial Sequence
  Synthetic polypeptide
  MOD_RES (3)..(3): Xaa is Methylglutamine
  MOD_RES (16)..(16): Xaa is Aib
HSXGTFTSDYSKYLDXRRAADFVAWLMDE

SEQ ID NO: 1252 - protein, 29 aa, Artificial Sequence
  Synthetic polypeptide
HSQGTFTSDYSKYLDSRRAQDFVQWLMDT

SEQ ID NO: 1253 - protein, 29 aa, Artificial Sequence
  Synthetic polypeptide
  MOD_RES (3)..(3): Xaa is Acetyldiaminobutanoic acid
  MOD_RES (16)..(16): Xaa is Aib
HSXGTFTSDYSKYLDXRRAADFVAWLLDE

SEQ ID NO: 1254 - protein, 39 aa, Artificial Sequence; identical to SEQ ID NO: 604
  Synthetic polypeptide
  MOD_RES (3)..(3): Xaa is Acetyldiaminobutanoic acid
  MOD_RES (16)..(16): Xaa is Aib
  MISC_FEATURE (39)..(39): C-terminal amidation

SEQ ID NO: 1255 - protein, 29 aa, Artificial Sequence
  Synthetic polypeptide
  MOD_RES (3)..(3): Xaa is Acetyldiaminobutanoic acid
  MOD_RES (16)..(16): Xaa is Aib
HSXGTFTSDYSKYLDXRRASDFVSWLLDE

SEQ ID NO: 1256 - protein, 29 aa, Artificial Sequence
  Synthetic polypeptide
  MOD_RES (3)..(3): Xaa is Acetyldiaminobutanoic acid
  MOD_RES (16)..(16): Xaa is Aib
HSXGTFTSDYSKYLDXRRATDFVTWLLDE

SEQ ID NO: 1257-1258 - skipped (2 entries)

SEQ ID NO: 1259 - protein, 40 aa, Artificial Sequence
  Synthetic peptide
  MOD_RES (2)..(2): Xaa is Aib
  MISC_FEATURE (16)..(20): Lactam bridge links Glu16 and Lys20
  MOD_RES (40)..(40): Epsilon amine of Lys is attached to Ala-Ac-Cys(PEG), wherein the Ac-Cys(PEG) is a Cys residue comprising an alpha amino group capped with an acetyl group (CH3CO) and comprising a 40 kDa PEG covalently attached to its side chain
YXQGTFTSDYSIYLDEQAAKEFVNWLLAGGPSSGAPPPSK

SEQ ID NO: 1260 - protein, 40 aa, Artificial Sequence; identical to SEQ ID NO: 1259
  Synthetic peptide
  MOD_RES (2)..(2): Xaa is Aib
  MISC_FEATURE (16)..(20): Lactam bridge links Glu16 and Lys20
  MOD_RES (40)..(40): Epsilon amine of Lys is attached to Arg-Ac-Cys(PEG), wherein the Ac-Cys(PEG) is a Cys residue comprising an alpha amino group capped with an acetyl group (CH3CO) and comprising a 40 kDa PEG covalently attached to its side chain

SEQ ID NO: 1261 - protein, 40 aa, Artificial Sequence; identical to SEQ ID NO: 761
  Synthetic peptide
  MOD_RES (2)..(2): Xaa is Aib
  MISC_FEATURE (16)..(20): Lactam bridge links Glu16 and Lys20
  MOD_RES (40)..(40): Cys-PEG covalently linked via thioether linkage

SEQ ID NO: 1262 - protein, 40 aa, Artificial Sequence
  Synthetic peptide
  MOD_RES (2)..(2): Xaa is Aib
HXQGTFTSDYSKYLDERRAQDFVQWLMNTGPSSGAPPPSK

SEQ ID NO: 1263-1300 - skipped (38 entries)

SEQ ID NO: 1301 - protein, 29 aa, Homo sapiens
HSQGTFTSDYSKYLDSRRAQDFVQWLMNT

SEQ ID NO: 1302 - protein, 28 aa, Artificial Sequence
  Synthetic Polypeptide
  MISC_FEATURE: Glucagon analogue
  MISC_FEATURE (8)..(8): Xaa is aspartic acid, glutamic acid, cysteic acid or homocysteic acid
SQGTFTSXYSKYLDSRRAQDFVQWLMNT

SEQ ID NO: 1303 - protein, 27 aa, Artificial Sequence
  Synthetic Polypeptide
  MISC_FEATURE: Glucagon analogue
  MISC_FEATURE (7)..(7): Xaa is aspartic acid, glutamic acid, cysteic acid or homocysteic acid
QGTFTSXYSKYLDSRRAQDFVQWLMNT

SEQ ID NO: 1304 - protein, 26 aa, Artificial Sequence
  Synthetic Polypeptide
  MISC_FEATURE: Glucagon analogue
  MISC_FEATURE (6)..(6): Xaa is aspartic acid, glutamic acid, cysteic acid or homocysteic acid
GTFTSXYSKYLDSRRAQDFVQWLMNT

SEQ ID NO: 1305 - protein, 25 aa, Artificial Sequence
  Synthetic Polypeptide
  MISC_FEATURE: Glucagon analogue
  MISC_FEATURE (5)..(5): Xaa is aspartic acid, glutamic acid, cysteic acid or homocysteic acid
TFTSXYSKYLDSRRAQDFVQWLMNT

SEQ ID NO: 1306 - protein, 24 aa, Artificial Sequence
  Synthetic Polypeptide
  MISC_FEATURE: Glucagon analogue
  MISC_FEATURE (4)..(4): Xaa is glutamic acid, cysteic acid or homocysteic acid
  MISC_FEATURE (22)..(22): Xaa at position 22 is Met, Leu or Nle
FTSXYSKYLDSRRAQDFVQWLXNT

SEQ ID NO: 1307 - protein, 24 aa, Artificial Sequence
  Synthetic Polypeptide
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQDFVQWLXNT

SEQ ID NO: 1308 - protein, 24 aa, Artificial Sequence
  Synthetic Polypeptide
  MOD_RES (1)..(1): N-terminal amino group replaced with hydroxy group
  MISC_FEATURE (22)..(22): Xaa is  Met, Leu or Nle
  MOD_RES (24)..(24): C-terminal alpha carboxylate replaced with amide
FTSDYSRYLDSRRAQDFVQWLXNT

SEQ ID NO: 1309 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (11)..(11): Xaa is Lys, Cys, Orn, homocysteine or acetyl phenyalanine
  MISC_FEATURE (22)..(22): Xaa is Met, Leu or Nle
FTSXYSXYLDXRRAQDFVQWLXNT

SEQ ID NO: 1310 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is is Lys or Arg
  MISC_FEATURE (16)..(16): Xaa is Lys, Cys, Orn, homocysteine or acetyl phenylalanine
  MISC_FEATURE (22)..(22): Xaa is Met, Leu or Nle
FTSXYSXYLDSRRAQXFVQWLXNT

SEQ ID NO: 1311 - protein, 24 aa, Artificial Sequence
  Synthetic Polypetide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MISC_FEATURE (22)..(22): Xaa is Met, Leu or Nle
FTSXYSXYLDSRRAQDFVXWLXNT

SEQ ID NO: 1312 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (11)..(11): Xaa is Lys, Cys, Orn, homocysteine or acetyl phenylalanine
  MISC_FEATURE (19)..(19): Xaa is Lys, Cys, Orn, homocysteine or acetyl phenylalanine
  MISC_FEATURE (22)..(22): Xaa is Met, Leu or Nle
FTSXYSXYLDXRRAQDFVXWLXNT

SEQ ID NO: 1313 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (11)..(11): Pegylated
  MISC_FEATURE (22)..(22): Xaa is Met, Leu or Nle
FTSXYSKYLDCRRAQDFVQWLXNT

SEQ ID NO: 1314 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (19)..(19): Pegylated
  MISC_FEATURE (22)..(22): Xaa is Met, Leu or Nle
FTSXYSKYLDSRRAQDFVCWLXNT

SEQ ID NO: 1315 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
  MOD_RES (24)..(24): Pegylated
FTSXYSKYLDSRRAQDFVQWLXNC

SEQ ID NO: 1316 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (19)..(19): Pegylated
  MISC_FEATURE (22)..(22): Xaa is Met, Leu or Nle
FTSXYSRYLDSRRAQDFVKWLXNT

SEQ ID NO: 1317 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (11)..(11): Pegylated
  MISC_FEATURE (22)..(22): Xaa is Met, Leu or Nle
FTSXYSKYLDCRRAQDFVCWLXNT

SEQ ID NO: 1318 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
  MOD_RES (24)..(24): C-terminal alpha carboxylate replaced with amide
FTSXYSKYLECRRAQDFVQWLXNT

SEQ ID NO: 1319 - protein, 10 aa, Artificial Sequence
  Synthetic Polypeptide
  MISC_FEATURE: Peptide fragment representing the carboxy terminal 10 amino acids of Exendin-4
GPSSGAPPPS

SEQ ID NO: 1320 - protein, 8 aa, Artificial Sequence
  Synthetic Polypeptide
  MISC_FEATURE: Peptide fragment representing the carboxy terminal 8 amino acids of oxyntomodulin
KRNRNNIA

SEQ ID NO: 1321 - protein, 4 aa, Artificial Sequence
  Synthetic Polypeptide
  MISC_FEATURE: Peptide fragment representing the carboxy 4 amino acids of oxyntomodulin carboxy terminus
KRNR

SEQ ID NO: 1322 - protein, 24 aa, Artificial Sequence
  Synthetic Polypeptide
  MISC_FEATURE: Glucagon analogue
  MISC_FEATURE (7)..(7): Xaa is Lys or Arg
  MISC_FEATURE (11)..(11): Xaa is Lys, Cys, Orn, homocycstein or acetyl phenyalanine
  MISC_FEATURE (19)..(19): Xaa is Lys, Cys, Orn, homocycstein or acetyl phenyalanine
FTSRYSXYLDXRRAQDFVXWLMNT

SEQ ID NO: 1323 - protein, 34 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (16)..(16): Xaa is Lys, Cys, Orn, homocysteine or acetyl phenylalanine
  MISC_FEATURE (22)..(22): Xaa is Met, Leu or Nle
FTSXYSXYLDSRRAQXFVQWLXNTGPSSGAPPPS

SEQ ID NO: 1324 - protein, 32 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDSRRAQDFVXWLXNTKRNRNNIA

SEQ ID NO: 1325 - protein, 34 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDSRRAQDFVXWLXNTGPSSGAPPPS

SEQ ID NO: 1326 - protein, 32 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (16)..(16): Xaa is Lys, Cys, Orn, homocysteine or acetyl phenylalanine
  MOD_RES (16)..(16): Pegylation
  MISC_FEATURE (22)..(22): Xaa is Met, Leu or Nle
FTSXYSXYLDSRRAQXFVQWLXNTKRNRNNIA

SEQ ID NO: 1327 - protein, 28 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (16)..(16): Xaa is Lys, Cys, Orn, homocysteine or acetyl phenylalanine
  MOD_RES (16)..(16): Pegylated
  MISC_FEATURE (22)..(22): Xaa is Met, Leu or Nle
FTSXYSXYLDSRRAQXFVQWLXNTKRNR

SEQ ID NO: 1328 - protein, 28 aa, Artificial Sequence
  Synthetic Polypeptide
  MISC_FEATURE: Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDSRRAQDFVXWLXNTKRNR

SEQ ID NO: 1329 - protein, 34 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQDFVQWLXNTGPSSGAPPPS

SEQ ID NO: 1330 - protein, 32 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQDFVQWLXNTKRNRNNIA

SEQ ID NO: 1331 - protein, 28 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQCFVQWLXNTKRNR

SEQ ID NO: 1332 - protein, 29 aa, Artificial Sequence
  Synthetic Polypeptide
  MISC_FEATURE: Glucagon analogue
HSQGTFTSDYSKYLDSCRAQDFVQWLMNT

SEQ ID NO: 1333 - protein, 39 aa, Artificial Sequence; identical to SEQ ID NO: 36
  Synthetic Polypeptide
  MISC_FEATURE: Glucagon analogue

SEQ ID NO: 1334 - protein, 29 aa, Artificial Sequence
  Synthetic Polypeptide
  MISC_FEATURE: Glucagon analogue
  MOD_RES (24)..(24): 2-butyrolactone bound through thiol group of Cysteine
HSQGTFTSDYSKYLDSRRAQCFVQWLMNT

SEQ ID NO: 1335 - protein, 29 aa, Artificial Sequence
  Synthetic Polypeptide
  MISC_FEATURE: Glucagon Analogue
  MOD_RES (24)..(24): Carboxymethyl group bound through thiol group of Cysteine
HSQGTFTSDYSKYLDSRRAQCFVQWLMNT

SEQ ID NO: 1336 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLESRRAQDFVQWLXNT

SEQ ID NO: 1337 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (22)..(22): Xaa is Met, Leu or Nle
FTSDYSKYLDSRRAQDFVQWLXNT

SEQ ID NO: 1338 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (22)..(22): Xaa is Met, Leu or Nle
FTSDYSKYLESRRAQDFVQWLXNT

SEQ ID NO: 1339 - protein, 24 aa, Artificial Sequence
  Synthetic Polypeptide
  MISC_FEATURE: Glucagon analogue
  MISC_FEATURE (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
  MISC_FEATURE (23)..(23): Xaa is Asn, Asp, Glu, cysteic acid or homocysteic acid
  MISC_FEATURE (24)..(24): Xaa id Thr, Asp, Glu, cysteic acid or homocysteic acid
FTSXYSKYLDSRRAQDFVQWLXXX

SEQ ID NO: 1340 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQDFVQWLXXX

SEQ ID NO: 1341 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Glu, cysteic acid, homoglutamic acid or homocysteic acid
  MISC_FEATURE (22)..(22): Xaa is Met, Leu or Nle
  MISC_FEATURE (23)..(23): Xaa is Asn, Asp or Glu
  MISC_FEATURE (24)..(24): Xaa is Thr, glu or Asp
FTSXYSKYLXSRRAQDFVQWLXXX

SEQ ID NO: 1342 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQDFVQWLXXX

SEQ ID NO: 1343 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MOD_RES (11)..(11): 20kDa PEG group attached to Xaa at position 11
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXCRRAQDFVQWLXXX

SEQ ID NO: 1344 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MOD_RES (16)..(16): 20kDa PEG group attached to Xaa at position 16
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQCFVQWLXXX

SEQ ID NO: 1345 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MOD_RES (19)..(19): Pegylated
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQDFVCWLXXX

SEQ ID NO: 1346 - protein, 35 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
  MISC_FEATURE (25)..(25): Xaa is Lys, Cys, Orn, homocycstein or acetyl phenyalanine
  MOD_RES (25)..(25): Pegylated
FTSXYSKYLXSRRAQDFVQWLXXXXGPSSGAPPPS

SEQ ID NO: 1347 - protein, 35 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
  MISC_FEATURE (35)..(35): Xaa is Lys, Cys, Orn, homocysteine or acetyl phenyalanine
  MOD_RES (35)..(35): Pegylated
FTSXYSKYLXSRRAQDFVQWLXXXGPSSGAPPPSX

SEQ ID NO: 1348 - protein, 39 aa, Artificial Sequence; identical to SEQ ID NO: 39
  Synthetic Polypeptide
  MISC_FEATURE: Glucagon analogue

SEQ ID NO: 1349 - protein, 35 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (22)..(22): Xaa is Met , Leu or Nle
  MISC_FEATURE (35)..(35): Xaa is Lys, Cys, Orn, homocysteine or acetyl phenyalanine
  MOD_RES (35)..(35): Pegylated
FTSXYSXYLDSRRAQDFVQWLXNTGPSSGAPPPSX

SEQ ID NO: 1350 - protein, 24 aa, Artificial Sequence
  Synthetic Polypeptide
  MISC_FEATURE: Glucagon analogue
  MOD_RES (1)..(1): N-terminal amino group replaced with hydroxy group
FTSEYSKYLDSRRAQDFVQWLMNT

SEQ ID NO: 1351 - protein, 20 aa, Artificial Sequence
  Synthetic Polypeptide
  MISC_FEATURE: Glucagon analogue
YSKYLDSRRAQDFVQWLMNT

SEQ ID NO: 1352 - protein, 24 aa, Artificial Sequence
  Synthetic Polypeptide
  MISC_FEATURE: Glucagon analogue
  MISC_FEATURE (4)..(4): Xaa is Homocysteic acid
FTSXYSKYLDSRRAQDFVQWLMNT

SEQ ID NO: 1353 - protein, 11 aa, Artificial Sequence
  Synthetic Polypeptide
  MISC_FEATURE: Peptide fragment representing the carboxy terminal 10 amino acids of Exendin-4
  MISC_FEATURE (11)..(11): Xaa is Lys, Cys, Orn, homocysteine or acetyl phenyalanine
GPSSGAPPPSX

SEQ ID NO: 1354 - protein, 6 aa, Artificial Sequence
  Synthetic Polypeptide
  MISC_FEATURE (6)..(6): Xaa is phenyl lactic acid
HSQGTX

SEQ ID NO: 1355 - protein, 5 aa, Artificial Sequence
  Synthetic Polypeptide
  MISC_FEATURE (5)..(5): Xaa is phenyl lactic acid
SQGTX

SEQ ID NO: 1356 - protein, 4 aa, Artificial Sequence
  Synthetic Polypeptide
  MISC_FEATURE (4)..(4): Xaa is phenyl lactic acid
QGTX

SEQ ID NO: 1357 - protein, 3 aa, Artificial Sequence
  Synthetic Polypeptide
  MISC_FEATURE (3)..(3): Xaa is phenyl lactic acid
GTX

SEQ ID NO: 1358 - protein, 2 aa, Artificial Sequence
  Synthetic Polypeptide
  MISC_FEATURE (2)..(2): Xaa is phenyl lactic acid
TX

SEQ ID NO: 1359 - protein, 6 aa, Artificial Sequence
  Synthetic Polypeptide
  MISC_FEATURE (1)..(1): Xaa is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, Val, Gly, N-methyl serine, N-methyl alanine, and aminoisobutyric acid (AIB)
  MISC_FEATURE (3)..(3): Xaa is selected from a group consisting of Glu or Gln
  MISC_FEATURE (6)..(6): Xaa is phenyl lactic acid
XXXGTX

SEQ ID NO: 1360 - protein, 5 aa, Artificial Sequence
  Synthetic Polypeptide
  MISC_FEATURE (1)..(1): Xaa is selected from a group consisting of Ser, D-serine, D-alanine, Val, Gly, N-methyl serine, N-methyl alanine, and aminoisobutyric acid (AIB)
  MISC_FEATURE (2)..(2): Xaa is selected from a group consisting of Glu or Gln
  MISC_FEATURE (5)..(5): Xaa is phenyl lactic acid
XXGTX

SEQ ID NO: 1361 - protein, 4 aa, Artificial Sequence
  Synthetic Polypeptide
  MISC_FEATURE (1)..(1): Xaa is selected from a group consisting of Glu and Gln
  MISC_FEATURE (4)..(4): Xaa is phenyl lactic acid
XGTX

SEQ ID NO: 1362 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate optionally replaced with amide
FTSDYSKYLDSRRAQDFVQWLMDT

SEQ ID NO: 1363 - protein, 28 aa, Artificial Sequence
  Synthetic Polypeptide
  MOD_RES (28)..(28): C-terminal alpha carboxylate optionally replaced with amide
SQGTFTSEYSKYLDSRRAQDFVQWLMNT

SEQ ID NO: 1364 - protein, 28 aa, Artificial Sequence
  Synthetic Polypeptide
  MISC_FEATURE (4)..(5): Threonine in position 4 and phenyl lactic acid in position 5 linked via ester bond
  MISC_FEATURE (5)..(5): Xaa is phenyl lactic acid
  MOD_RES (28)..(28): Optional C-terminal alpha carboxylate replaced with amide
  MOD_RES (28)..(28): C-terminal alpha carboxylate optionally replaced with amide
SQGTXTSEYSKYLDSRRAQDFVQWLMNT

SEQ ID NO: 1365 - protein, 29 aa, Artificial Sequence
  Synthetic Polypeptide
  MISC_FEATURE (5)..(6): Threonine in position 5 and phenyl lactic acid in position 6 linked via ester bond
  MISC_FEATURE (6)..(6): Xaa is phenyl lactic acid
  MOD_RES (29)..(29): C-terminal alpha carboxylate optionally replaced with amide
HSQGTXTSEYSKYLDSRRAQDFVQWLMNT

SEQ ID NO: 1366 - protein, 24 aa, Artificial Sequence
  Synthetic Polypeptide
  MOD_RES (1)..(1): N-terminal amino group replaced with hydroxy group
  MISC_FEATURE (11)..(11): Xaa is amino isobutyric acid
FTSDYSKYLDXRRAQDFVQWLMNT

SEQ ID NO: 1367 - protein, 24 aa, Artificial Sequence
  Synthetic Polypeptide
  MOD_RES (1)..(1): N-terminal amino group replaced with hydroxy group
FTSDYSKYLDERRAQDFVQWLMNT

SEQ ID NO: 1368 - protein, 6 aa, Artificial Sequence
  Synthetic Polypeptide
  MISC_FEATURE (1)..(1): Xaa is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, Val, Gly, N-methyl serine, N-methyl alanine, and aminoisobutyric acid (AIB)
  MISC_FEATURE (3)..(3): Xaa is selected from a group consisting of Glu or Gln
XXXTGF

SEQ ID NO: 1369 - protein, 5 aa, Artificial Sequence
  Synthetic Polypeptide
  MISC_FEATURE (1)..(1): Xaa is selected from a group consisting of Ser, D-serine, D-alanine, Val, Gly, N-methyl serine, N-methyl alanine, and aminoisobutyric acid (AIB)
  MISC_FEATURE (2)..(2): Xaa is selected from a group consisting of Glu or Gln
XXTGF

SEQ ID NO: 1370 - protein, 4 aa, Artificial Sequence
  Synthetic Polypeptide
  MISC_FEATURE (1)..(1): Xaa is selected from a group consisting of Glu or Gln
XTGF

SEQ ID NO: 1371 - protein, 24 aa, Artificial Sequence
  Synthetic Polypeptide
  MOD_RES (1)..(1): N-terminal amino group replaced with hydroxy group
  MISC_FEATURE (24)..(24): C-terminal alpha carboxylate optionally replaced with an amide
FTSEYSKYLDSRRAQDFVQWLMNT

SEQ ID NO: 1372-1400 - skipped (29 entries)

SEQ ID NO: 1401 - protein, 29 aa, Homo sapiens
HSQGTFTSDYSKYLDSRRAQDFVQWLMNT

SEQ ID NO: 1402 - protein, 24 aa, Artificial Sequence
  Synthetic Polypeptide
  MISC_FEATURE: Glucagon analogue
  MOD_RES (1)..(1): N-terminal amino group replaced with hydroxy group
FTSDYSKYLDSRRAQDFVQWLMNT

SEQ ID NO: 1403 - protein, 31 aa, Homo sapiens; identical to SEQ ID NO: 50

SEQ ID NO: 1404 - protein, 30 aa, Homo sapiens; identical to SEQ ID NO: 52

SEQ ID NO: 1405 - protein, 24 aa, Artificial Sequence
  Synthetic Polypeptide
  MISC_FEATURE: Glucagon analogue
  MOD_RES (1)..(1): N-terminal amino group replaced with hydroxy group
FTSDYSKYLDERRAQDFVQWLMNT

SEQ ID NO: 1406 - protein, 24 aa, Artificial Sequence
  Synthetic Polypeptide
  MOD_RES (1)..(1): N-terminal amino group replaced with hydroxy group
FTSDYSKYLDERRAKDFVQWLMNT

SEQ ID NO: 1407 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(11): Xaa is Ser or Glu
FTSDYSKYLDXRRAKDFVEWLMNT

SEQ ID NO: 1408 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(11): Xaa is Ser or Glu
FTSDYSKYLDXRRAQDFVEWLMKT

SEQ ID NO: 1409 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (7)..(7): Xaa at position 7 is Lys or Glu
  MISC_FEATURE (10)..(10): Xaa is Asp, Glu, homoglutamic acid, cysteic acid or homocysteic acid
  MISC_FEATURE (11)..(11): Xaa is Ala, Ser, Glu, Lys, homoglutamic acid or homocysteic acid
  MISC_FEATURE (15)..(15): Xaa is Gln, Glu or Lys
  MISC_FEATURE (19)..(19): Xaa is Ala, Gln, Lys or Glu
  MISC_FEATURE (23)..(23): Xaa is Asn, Lys or an acidic amino acid
  MISC_FEATURE (24)..(24): Xaa is Thr or an acidic amino acid
FTSDYSXYLXXRRAXDFVXWLMXX

SEQ ID NO: 1410 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(11): Xaa is Ala, Ser, Glu, Gln, homoglutamic acid or homocysteic acid
  MISC_FEATURE (15)..(15): Xaa is Gln or Lys
  MISC_FEATURE (19)..(19): Xaa is Ala, Gln or Glu
  MISC_FEATURE (23)..(23): Xaa is Asn, Lys or an acidic amino acid
FTSDYSKYLDXRRAXDFVXWLMXT

SEQ ID NO: 1411 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(11): Xaa is Ala, Ser, Glu, Gln, homoglutamic acid or homocysteic acid
  MISC_FEATURE (15)..(15): Xaa is Gln or Lys
FTSDYSKYLDXRRAXDFVQWLMNT

SEQ ID NO: 1412 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (15)..(15): Xaa is Lys or Gln
  MISC_FEATURE (16)..(16): Xaa is Lys, Cys, Orn, homocysteine or acetyl phenyalanine
  MOD_RES (16)..(16): Pegylated
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDERRAXXFVXWLXNT

SEQ ID NO: 1413 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (15)..(15): Xaa is Lys or Gln
  MISC_FEATURE (16)..(16): Xaa is Cys, Orn, homocysteine or acetyl phenyalanine
  MOD_RES (16)..(16): Pegylated
  MISC_FEATURE (22)..(22): Xaa is Met, Leu or Nle
FTSXYSKYLDERRAXXFVQWLXNT

SEQ ID NO: 1414 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (15)..(15): Xaa is Lys or Gln
  MISC_FEATURE (19)..(19): Xaa is Cys, Orn, homocysteine or acetyl phenylalanine
  MOD_RES (19)..(19): Pegylated
  MISC_FEATURE (22)..(22): Xaa is Met, Leu or Nle
FTSXYSKYLDERRAXDFVXWLXNT

SEQ ID NO: 1415 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid, homoglutamic acid or homocysteic acid
  MISC_FEATURE (7)..(7): Xaa is Lys or Glu
  MISC_FEATURE (10)..(10): Xaa is Asp, Glu, cysteic acid, homoglutamic acid or homocysteic acid
  MISC_FEATURE (11)..(11): Xaa is Ala, Ser, Glu, Lys Gln, homoglutamic acid or homocysteic acid
  MISC_FEATURE (15)..(15): Xaa is Arg, Gln, Glu or Lys
  MISC_FEATURE (19)..(19): Xaa is Ala, Gln, Lys or Glu
  MISC_FEATURE (22)..(22): Xaa is Met, Leu or Nle
  MISC_FEATURE (23)..(23): Xaa is Asn, Lys or an acidic amino acid
  MISC_FEATURE (24)..(24): Xaa is Thr or an acidic amino acid
FTSXYSXYLXXRRAXDFVXWLXXX

SEQ ID NO: 1416 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (7)..(11): Lactam bridge connecting residues 7 and 11
  MISC_FEATURE (10)..(10): Xaa is Glu or Asp
  MISC_FEATURE (22)..(22): Xaa is Met, Leu or Nle
  MISC_FEATURE (23)..(23): Xaa is Asn, Asp or Glu
  MOD_RES (24)..(24): C-terminal alpha carboxylate replaced with amide
FTSDYSKYLXERRAQDFVQWLXXT

SEQ ID NO: 1417 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (10)..(10): Xaa is Asp or Glu
  MISC_FEATURE (11)..(15): Lactam bridge connecting residues 11 and 15
  MISC_FEATURE (22)..(22): Xaa is Met, Leu or Nle
  MISC_FEATURE (23)..(23): Xaa is Asn, Asp or Glu
  MOD_RES (24)..(24): C-terminal alpha carboxylate replaced with amide
FTSDYSKYLXERRAKDFVQWLXXT

SEQ ID NO: 1418 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (10)..(10): Xaa is Asp or Glu
  MISC_FEATURE (11)..(11): Xaa is Ser or Glu
  MISC_FEATURE (15)..(19): Lactam bridge connecting residues 15 and 19
  MISC_FEATURE (22)..(22): Xaa is Met, Leu or Nle
  MISC_FEATURE (23)..(23): Xaa is Asn, Asp or Glu
  MOD_RES (24)..(24): C-terminal alpha carboxylate replaced with amide
FTSDYSKYLXXRRAKDFVEWLXXT

SEQ ID NO: 1419 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (10)..(10): Xaa is Asp or Glu
  MISC_FEATURE (11)..(11): Xaa is Ser or Glu
  MISC_FEATURE (19)..(23): Lactam bridge connecting residues 19 and 23
  MISC_FEATURE (22)..(22): Xaa is Met, Leu or Nle
  MISC_FEATURE (24)..(24): Xaa is Thr or Glu
  MOD_RES (24)..(24): C-terminal alpha carboxylate replaced with amide
FTSDYSKYLXXRRAQDFVEWLXKX

SEQ ID NO: 1420 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Glu
  MISC_FEATURE (10)..(10): Xaa is Asp, Glu, cysteic acid, homoglutamic acid or homocysteic acid
  MISC_FEATURE (11)..(11): Xaa is Ala, Ser, Glu, Lys Gln, homoglutamic acid or homocysteine
  MISC_FEATURE (15)..(15): Xaa is Arg, Gln, Glu or Lys
  MISC_FEATURE (19)..(19): Xaa is Ala, Gln, Lys or Glu
  MISC_FEATURE (22)..(22): Xaa is Met, Leu or Nle
  MISC_FEATURE (23)..(23): Xaa is Asn, Lys, Asp, Glu, cysteic acid or homocysteic acid
  MISC_FEATURE (24)..(24): Xaa is Thr, Asp, Glu, cysteic acid and homocysteic acid
FTSXYSXYLXXRRAXDFVXWLXXX

SEQ ID NO: 1421 - protein, 10 aa, Artificial Sequence
  Synthetic Polypeptide
  MISC_FEATURE: Peptide fragment representing the carboxy terminal 10 amino acids of Exendin-4
GPSSGAPPPS

SEQ ID NO: 1422 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(11): Lactam bridge connecting residues 7 and 11
  MISC_FEATURE (10)..(10): Xaa is Asp, Glu, cysteic acid, homoglutamic acid and homocysteic acid
  MISC_FEATURE (22)..(22): Xaa is Met, Leu or Nle
FTSXYSKYLXERRAQDFVQWLXNT

SEQ ID NO: 1423 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid and homocysteic acid
  MISC_FEATURE (11)..(15): Lactam bridge connecting residues 11 and 15
  MISC_FEATURE (22)..(22): Xaa is Met, Leu or Nle
FTSXYSKYLXERRAKDFVQWLXNT

SEQ ID NO: 1424 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid and homocysteic acid
  MISC_FEATURE (15)..(19): Lactam bridge connecting residues 15 and 19
  MISC_FEATURE (22)..(22): Xaa is Met, Leu or Nle
FTSXYSKYLXERRAKDFVEWLXNT

SEQ ID NO: 1425 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid and homocysteic acid
  MISC_FEATURE (19)..(24): Lactam bridge connecting residues 19 and 24
  MISC_FEATURE (22)..(22): Xaa is Met, Leu or Nle
FTSXYSKYLXERRAQDFVEWLXKT

SEQ ID NO: 1426 - protein, 8 aa, Artificial Sequence
  Synthetic Polypeptide
  MISC_FEATURE: Peptide fragment representing the carboxy terminal 8 amino acids of oxyntomodulin
KRNRNNIA

SEQ ID NO: 1427 - protein, 4 aa, Artificial Sequence
  Synthetic Polypeptide
  MISC_FEATURE: Peptide fragment representing the carboxy 4 amino acids of oxyntomodulin carboxy terminus
KRNR

SEQ ID NO: 1428 - protein, 34 aa, Artificial Sequence
  Synthetic Polypeptide
  MISC_FEATURE: Glucagon analogue
FTSEYSKYLDERRAQDFVQWLMNTGPSSGAPPPS

SEQ ID NO: 1429 - protein, 34 aa, Artificial Sequence; identical to SEQ ID NO: 1428
  Synthetic Polypeptide
  MISC_FEATURE (7)..(11): Lactam bridge connecting residues 7 and 11

SEQ ID NO: 1430 - protein, 34 aa, Artificial Sequence
  Synthetic Polypeptide
  MISC_FEATURE: Glucagon analogue
  MISC_FEATURE (11)..(15): Lactam bridge connecting residues 11 and 15
FTSEYSKYLDERRAKDFVQWLMNTGPSSGAPPPS

SEQ ID NO: 1431 - protein, 34 aa, Artificial Sequence
  Synthetic Polypeptide
  MISC_FEATURE: Glucagon analogue
  MISC_FEATURE (7)..(11): Lactam bridge connecting residues 7 and 11
FTSDYSKYLDERRAQDFVQWLMNTGPSSGAPPPS

SEQ ID NO: 1432 - protein, 34 aa, Artificial Sequence; identical to SEQ ID NO: 1428
  Synthetic Polypeptide
  MISC_FEATURE: Glucagon analogue
  MOD_RES (1)..(1): N-terminal amino group replaced with hydroxy group
  MISC_FEATURE (7)..(11): Lactam bridge connecting residues 7 and 11

SEQ ID NO: 1433 - protein, 34 aa, Artificial Sequence; identical to SEQ ID NO: 1430
  Synthetic Polypeptide
  MISC_FEATURE: Glucagon analogue
  MOD_RES (1)..(1): N-terminal amino group replaced with hydroxy group
  MISC_FEATURE (11)..(15): Lactam bridge connecting residues 11 and 15

SEQ ID NO: 1434 - protein, 24 aa, Artificial Sequence
  Synthetic Polypeptide
  MISC_FEATURE: Glucagon analogue
  MOD_RES (1)..(1): N-terminal amino group replaced with hydroxy group
FTSDYSKYLDSRRAQDFVQWLMDT

SEQ ID NO: 1435 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (7)..(11): Lactam bridge connecting residues 7 and 11
FTSEYSKYLDERRAQDFVQWLMNT

SEQ ID NO: 1436 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (11)..(15): Lactam bridge connecting residues 11 and 15
FTSEYSKYLDERRAKDFVQWLMNT

SEQ ID NO: 1437 - protein, 31 aa, Artificial Sequence
  Synthetic Polypeptide
  MISC_FEATURE: Glucagon analogue
HSQGTFTSDYARYLDARRAREFIKWLVRGRG

SEQ ID NO: 1438 - protein, 24 aa, Artificial Sequence
  Synthetic Polypeptide
  MISC_FEATURE: Glucagon analogue
  MOD_RES (1)..(1): N-terminal amino group replaced with hydroxy group
  MOD_RES (24)..(24): C-terminal alpha carboxylate replaced with amide
FTSDYSKYLDERRAQDFVQWLMNT

SEQ ID NO: 1439 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MOD_RES (24)..(24): C-terminal alpha carboxylate replaced with amide
FTSXYSKYLXERRAKDFVQWLXNT

SEQ ID NO: 1440 - protein, 29 aa, Artificial Sequence
  Synthetic Polypeptide
  MISC_FEATURE: Glucagon analogue
HSQGTFTSDYSKYLDSCRAQDFVQWLMNT

SEQ ID NO: 1441 - protein, 39 aa, Artificial Sequence; identical to SEQ ID NO: 36
  Synthetic Polypeptide
  MISC_FEATURE: Glucagon Analogue

SEQ ID NO: 1442 - protein, 29 aa, Artificial Sequence
  Synthetic Polypeptide
  MISC_FEATURE: Glucagon analogue
  MOD_RES (24)..(24): 2-butyrolactone bound through thiol group of Cysteine
HSQGTFTSDYSKYLDSRRAQCFVQWLMNT

SEQ ID NO: 1443 - protein, 29 aa, Artificial Sequence
  Synthetic Polypeptide
  MISC_FEATURE: Glucagon Analogue
  MOD_RES (21)..(21): Carboxymethyl group bound through thiol group of Cysteine
HSQGTFTSDYSKYLDSRRAQCFVQWLMNT

SEQ ID NO: 1444 - protein, 39 aa, Homo sapiens
HSQGTFTSDYSRYLDSRRAQDFVQWLRNTGPSSGAPPPS

SEQ ID NO: 1445 - protein, 35 aa, Artificial Sequence; identical to SEQ ID NO: 1346
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(11): Lactam bridge connecting residues 7 and 11
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MISC_FEATURE (23)..(23): Xaa is Asn, Lys, Asp, Glu, cysteic acid and homocysteic acid
  MISC_FEATURE (24)..(24): Xaa is Thr, Asp, Glu, cysteic acid and homocysteic acid
  MISC_FEATURE (25)..(25): Xaa is Cys, Orn, homocysteine or acetyl phenyalanine
  MOD_RES (25)..(25): Pegylated

SEQ ID NO: 1446 - protein, 35 aa, Artificial Sequence; identical to SEQ ID NO: 1347
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (11)..(15): Lactam bridge connecting residues 11 and 15
  MISC_FEATURE (22)..(22): Xaa is Met, Leu or Nle
  MISC_FEATURE (23)..(23): Xaa is Asn, Lys, Asp, Glu, cysteic acid and homocysteic acid
  MISC_FEATURE (24)..(24): Xaa is Thr, Asp, Glu, cysteic acid and homocysteic acid
  MISC_FEATURE (35)..(35): Xaa is Cys, Orn, homocysteine or acetyl phenyalanine
  MOD_RES (35)..(35): Pegylated

SEQ ID NO: 1447 - protein, 24 aa, Artificial Sequence
  Synthetic Polypeptide
  MISC_FEATURE: Glucagon analogue
  MISC_FEATURE (4)..(4): Xaa is glutamic acid, homoglutamic acid, cysteic acid or homocysteic acid
  MISC_FEATURE (7)..(11): Lactam bridge connecting residues 7 and 11
  MISC_FEATURE (10)..(10): Xaa is Glu or Asp
  MISC_FEATURE (22)..(22): Xaa is Met, Leu or Nle
  MISC_FEATURE (23)..(23): Xaa is Asn, Asp or Glu
FTSXYSKYLXERRAQDFVQWLXXT

SEQ ID NO: 1448 - protein, 24 aa, Artificial Sequence
  Synthetic Polypeptide
  MISC_FEATURE: Glucagon analogue
  MISC_FEATURE (4)..(4): Xaa is glutamic acid, homoglutamic acid,  cysteic acid or homocysteic acid
  MISC_FEATURE (10)..(10): Xaa is Asp or Glu
  MISC_FEATURE (11)..(15): Lactam bridge connecting residues 11 and 15
  MISC_FEATURE (22)..(22): Xaa is Met, Leu or Nle
  MISC_FEATURE (23)..(23): Xaa is Asn, Asp or Glu
FTSXYSKYLXERRAKDFVQWLXXT

SEQ ID NO: 1449 - protein, 23 aa, Artificial Sequence
  Synthetic Polypeptide
  MISC_FEATURE: Glucagon analogue
TSDYSKYLDERRAKDFVQWLMDT

SEQ ID NO: 1450 - protein, 11 aa, Artificial Sequence
  Synthetic Polypeptide
  MISC_FEATURE: Peptide fragment representing the carboxy terminal 10 amino acids of Exendin-4 plus one additional amino acid
  MISC_FEATURE (11)..(11): Xaa is selected form the group consisting of Cys, Orn, Lys, homocysteine and acetyl phenyalanine
GPSSGAPPPSX

SEQ ID NO: 1451 - protein, 24 aa, Artificial Sequence
  Synthetic Polypeptide
  MISC_FEATURE: Glucagon analogue
  MOD_RES (1)..(1): N-terminal amino group replaced with hydroxy group
  MISC_FEATURE (4)..(4): Xaa is aspartic acid, glutamic acid, cysteic acid, homoglutamic acid or homocysteic acid
  MISC_FEATURE (7)..(7): Xaa is Lys or Glu
  MISC_FEATURE (10)..(10): Xaa is Asp, Glu, cysteic acid, homoglutamic acid or homocysteic acid
  MISC_FEATURE (11)..(11): Xaa is Ala, Ser, Glu, Lys Gln, homoglutamic acid or homocysteic acid
  MISC_FEATURE (15)..(15): Xaa is Arg, Gln, Glu or Lys
  MISC_FEATURE (19)..(19): Xaa is Ala, Gln, Lys or Glu
  MISC_FEATURE (22)..(22): Xaa is Met, Leu or Nle
  MISC_FEATURE (23)..(23): Xaa is Asn, Lys or an acidic amino acid
  MISC_FEATURE (24)..(24): Xaa is Thr, Gly or an acidic amino acid
FTSXYSXYLXXRRAXDFVXWLXXX

SEQ ID NO: 1452 - protein, 6 aa, Artificial Sequence
  Synthetic Polypeptide
  MISC_FEATURE (6)..(6): Xaa is phenyl lactic acid
HSQGTX

SEQ ID NO: 1453 - protein, 5 aa, Artificial Sequence
  Synthetic Polypeptide
  MISC_FEATURE (5)..(5): Xaa is phenyl lactic acid
SQGTX

SEQ ID NO: 1454 - protein, 4 aa, Artificial Sequence
  Synthetic Polypeptide
  MISC_FEATURE (4)..(4): Xaa is phenyl lactic acid
QGTX

SEQ ID NO: 1455 - protein, 3 aa, Artificial Sequence
  Synthetic Polypeptide
  MISC_FEATURE (3)..(3): Xaa is phenyl lactic acid
GTX

SEQ ID NO: 1456 - protein, 2 aa, Artificial Sequence
  Synthetic Polypeptide
  MISC_FEATURE (2)..(2): Xaa is phenyl lactic acid
TX

SEQ ID NO: 1457 - protein, 6 aa, Artificial Sequence
  Synthetic Polypeptide
  MISC_FEATURE (1)..(1): Xaa is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, Val, Gly, N-methyl serine, N-methyl alanine, and aminoisobutyric acid (AIB)
  MISC_FEATURE (3)..(3): Xaa is selected from a group consisting of Glu or Gln
  MISC_FEATURE (6)..(6): Xaa is phenyl lactic acid
XXXGTX

SEQ ID NO: 1458 - protein, 5 aa, Artificial Sequence
  Synthetic Polypeptide
  MISC_FEATURE (1)..(1): Xaa is selected from a group consisting of Ser, D-serine, D-alanine, Val, Gly, N-methyl serine, N-methyl alanine, and aminoisobutyric acid (AIB)
  MISC_FEATURE (2)..(2): Xaa is selected from a group consisting of Glu or Gln
  MISC_FEATURE (5)..(5): Xaa is phenyl lactic acid
XXGTX

SEQ ID NO: 1459 - protein, 4 aa, Artificial Sequence
  Synthetic Polypeptide
  MISC_FEATURE (1)..(1): Xaa is selected from a group consisting of Glu or Gln
  MISC_FEATURE (4)..(4): Xaa is phenyl lactic acid
XGTX

SEQ ID NO: 1460 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDERRAKDFVQWLMDT

SEQ ID NO: 1461 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate replaced with amide
FTSEYSKYLDSRRAQDFVQWLMNT

SEQ ID NO: 1462 - protein, 24 aa, Artificial Sequence
  Synthetic Polypeptide
  MOD_RES (1)..(1): N-terminal amino group replaced with hydroxy group
  MISC_FEATURE (4)..(7): Lactam bridge connecting residues 4 and 7
  MOD_RES (24)..(24): C-terminal alpha carboxylate replaced with amide
FTSEYSKYLDSRRAQDFVQWLMNT

SEQ ID NO: 1463 - protein, 28 aa, Artificial Sequence
  Synthetic Polypeptide
  MISC_FEATURE (15)..(19): Lactam bridge connecting residues 15 and 19
  MOD_RES (28)..(28): C-terminal alpha carboxylate replaced with amide
AEGTFTSEYSKYLDERRAKDFVQWLMDT

SEQ ID NO: 1464 - protein, 28 aa, Artificial Sequence
  Synthetic Polypeptide
  MISC_FEATURE (4)..(5): Threonine in position 4 and phenyl lactic acid in position 5 are linked via ester bond
  MISC_FEATURE (5)..(5): Xaa is phenyl lactic acid
  MISC_FEATURE (15)..(19): Lactam bridge connecting residues 15 and 19
  MOD_RES (28)..(28): C-terminal alpha carboxylate replaced with amide
AEGTXTSDYSKYLDERRAKDFVQWLMDT

SEQ ID NO: 1465 - protein, 28 aa, Artificial Sequence
  Synthetic Polypeptide
  MISC_FEATURE (15)..(19): Lactam bridge connecting residues 15 and 19
  MOD_RES (28)..(28): C-terminal alpha carboxylate replaced with amide
SQGTFTSEYSKYLDERRAKDFVQWLMDT

SEQ ID NO: 1466 - protein, 28 aa, Artificial Sequence
  Synthetic Polypeptide
  MISC_FEATURE (4)..(5): Threonine in position 4 and phenyl lactic acid in position 5 are linked via ester bond
  MISC_FEATURE (5)..(5): Xaa is phenyl lactic acid
  MISC_FEATURE (15)..(19): Lactam bridge connecting residues 15 and 19
  MOD_RES (28)..(28): C-terminal alpha carboxylate replaced with amide
SQGTXTSDYSKYLDERRAKDFVQWLMDT

SEQ ID NO: 1467 - protein, 24 aa, Artificial Sequence
  Synthetic Polypeptide
  MOD_RES (1)..(1): N-terminal amino group replaced with hydroxy group
  MISC_FEATURE (5)..(5): Covalently linked to a cholesterol acid moiety
  MISC_FEATURE (11)..(15): Lactam bridge connecting residues 11 to 15
  MOD_RES (24)..(24): C-terminal alpha carboxylate replaced with amide
FTSDKSKYLDERRAKDFVQWLMDT

SEQ ID NO: 1468 - protein, 25 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MISC_FEATURE (25)..(25): Covalently linked to a cholesterol acid moiety
  MOD_RES (25)..(25): C-terminal alpha carboxylate replaced with amide
FTSDYSKYLDERRAKDFVQWLMDTK

SEQ ID NO: 1469 - protein, 35 aa, Artificial Sequence
  Synthetic Polypeptide
  MOD_RES (1)..(1): N-terminal amino group replaced with hydroxy group
  MISC_FEATURE (11)..(15): Lactam bridge connectiong residues 11 and 15
  MISC_FEATURE (35)..(35): Covalently linked to a cholesterol acid moiety
  MOD_RES (35)..(35): C-terminal alpha carboxylate replaced with amide
FTSDYSKYLDERRAKDFVQWLMDTGPSSGAPPPSK

SEQ ID NO: 1470 - protein, 28 aa, Artificial Sequence
  Synthetic Polypeptide
  MISC_FEATURE (1)..(1): Xaa is amino isobutyric acid
  MISC_FEATURE (4)..(5): Threonine in position 4 and phenyl lactic acid in position 5 are linked via ester bond
  MISC_FEATURE (5)..(5): Xaa is phenyl lactic acid
  MISC_FEATURE (15)..(19): Lactam bridge connectiong residues 15 and 19
  MOD_RES (28)..(28): C-terminal alpha carboxylate replaced with amide
XEGTXTSDYSKYLDERRAKDFVQWLMDT

SEQ ID NO: 1471 - protein, 34 aa, Artificial Sequence; identical to SEQ ID NO: 1428
  Synthetic Polypeptide
  MOD_RES (34)..(34): C-terminal alpha carboxylate replaced with amide

SEQ ID NO: 1472 - protein, 34 aa, Artificial Sequence; identical to SEQ ID NO: 1428
  Synthetic Polypeptide
  MOD_RES (1)..(1): N-terminal amino group replaced with hydroxy group
  MOD_RES (34)..(34): C-terminal alpha carboxylate replaced with amide

SEQ ID NO: 1473 - protein, 34 aa, Artificial Sequence; identical to SEQ ID NO: 1430
  Synthetic Polypeptide
  MISC_FEATURE (11)..(15): Lactam bridge connecting residues 11 and 15
  MOD_RES (34)..(34): C-terminal alpha carboxylate replaced with amide

SEQ ID NO: 1474 - protein, 34 aa, Artificial Sequence; identical to SEQ ID NO: 1430
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (34)..(34): C-termincal alpha carboxylate replaced with amide

SEQ ID NO: 1475 - protein, 24 aa, Artificial Sequence
  Synthetic Polypeptide
  MOD_RES (1)..(1): N-terminal amino group replaced with hydroxy group
  MISC_FEATURE (7)..(11): Lactam bridge connecting residues 7 and 11
  MOD_RES (24)..(24): C-terminal alpha carboxylate replaced with amide
FTSDYSKYLDERRAQDFVQWLMDT

SEQ ID NO: 1476 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDERRAKDFVQWLMDT

SEQ ID NO: 1477 - protein, 24 aa, Artificial Sequence
  Synthetic Polypeptide
  MOD_RES (1)..(1): N-terminal amino group replaced with hydroxy group
  MISC_FEATURE (15)..(19): Lactam bridge connecting residues 15 and 19
  MOD_RES (24)..(24): C-terminal alpha carboxylate replaced with amide
FTSDYSKYLDERRAKDFVEWLMDT

SEQ ID NO: 1478 - protein, 24 aa, Artificial Sequence
  Synthetic Polypeptide
  MOD_RES (1)..(1): N-terminal amino group replaced with hydroxy group
  MISC_FEATURE (19)..(23): Lactam bridge connecting residues 19 and 23
  MOD_RES (24)..(24): C-terminal alpha carboxylate replaced with amide
FTSDYSKYLDERRAQDFVEWLMKT

SEQ ID NO: 1479 - protein, 24 aa, Artificial Sequence
  Synthetic Polypeptide
  MOD_RES (1)..(1): N-terminal amino group replaced with hydroxy group
  MISC_FEATURE (7)..(11): Lactam bridge connecting residues 7 and 11
  MOD_RES (24)..(24): C-terminal alpha carboxylate replaced with amide
FTSDYSKYLDEQAAKDFIAWLMDT

SEQ ID NO: 1480 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDEQAAKEFIAWLMDT

SEQ ID NO: 1481 - protein, 28 aa, Artificial Sequence
  Synthetic Polypeptide
  MISC_FEATURE (15)..(19): Lactam bridge connecting residues 15 and 19
  MOD_RES (28)..(28): C-terminal alpha carboxylate replaced with amide
AEGTFTSEYSKYLDERRAKDFVQWLMDT

SEQ ID NO: 1482 - protein, 28 aa, Artificial Sequence
  Synthetic Polypeptide
  MISC_FEATURE (15)..(19): Lactam bridge connecting residues 15 and 19
  MOD_RES (28)..(28): C-terminal alpha carboxylate replaced with amide
AEGTFTSEYSKYLDEQAAKEFIAWLMDT

SEQ ID NO: 1483 - protein, 29 aa, Artificial Sequence
  Synthetic Polypeptide
  MISC_FEATURE (16)..(20): Lactam bridge connection residues 16 and 20
  MOD_RES (29)..(29): C-terminal alpha carboxylate replaced with amide
HAEGTFTSEYSKYLDERRAKDFVQWLMDT

SEQ ID NO: 1484 - protein, 29 aa, Artificial Sequence
  Synthetic Polypeptide
  MISC_FEATURE (16)..(20): Lactam bridge connecting bridges 16 and 20
  MOD_RES (29)..(29): C-terminal alpha carboxylate replaced with amide
HAEGTFTSEYSKYLDEQAAKEFIAWLMDT

SEQ ID NO: 1485 - protein, 26 aa, Artificial Sequence
  Synthetic Polypeptide
  MISC_FEATURE (13)..(17): Lactam bridge connecting residues 13 and 17
  MOD_RES (26)..(26): C-terminal alpha carboxylate replaced with amide
GTFTSEYSKYLDERRAKDFVQWLMDT

SEQ ID NO: 1486 - protein, 28 aa, Artificial Sequence
  Synthetic Polypeptide
  MISC_FEATURE (5)..(6): Threonine in position 5 and phenyl lactic acid in position 6 linked via ester bond
  MISC_FEATURE (15)..(19): Lactam bridge connecting residues 15 and 19
  MOD_RES (28)..(28): C-terminal alpha carboxylate replaced with amide
SQGTFTSEYSKYLDERRAKDFVQWLMDT

SEQ ID NO: 1487 - protein, 29 aa, Artificial Sequence
  Synthetic Polypeptide
  MISC_FEATURE (5)..(6): Threonine at position 5 and phenyl lactic acid at position 6 linked via ester bond
  MISC_FEATURE (6)..(6): Xaa is phenyl lactic acid
  MISC_FEATURE (16)..(20): Lactam bridge connecting residues 16 and 20
  MOD_RES (29)..(29): C-terminal alpha carboxylate replaced with amide
HAEGTXTSDYSKYLDERRAKDFVQWLMDT

SEQ ID NO: 1488 - protein, 24 aa, Artificial Sequence
  Synthetic Polypeptide
  MOD_RES (1)..(1): N-terminal amino group replaced with hydroxy group
  MISC_FEATURE (7)..(11): Lactam bridge connecting residues 7 and 11
  MOD_RES (19)..(19): Pegylated
  MOD_RES (24)..(24): C-terminal alpha carboxylate replaced with amide
FTSDYSKYLDERRAQDFVCWLMDT

SEQ ID NO: 1489 - protein, 35 aa, Artificial Sequence
  Synthetic Polypeptide
  MOD_RES (1)..(1): N-terminal amino group replaced with hydroxy group
  MISC_FEATURE (7)..(11): Lactam bridge connecting residues 7 and 11
  MOD_RES (35)..(35): Pegylated
  MOD_RES (35)..(35): C-terminal alpha carboxylate replaced with amide
FTSDYSKYLDERRAQDFVQWLMDTGPSSGAPPPSC

SEQ ID NO: 1490 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (19)..(19): Pegylated
  MOD_RES (24)..(24): C-terminal alpha carboxylate replaced with amide
FTSDYSKYLDERRAKDFVCWLMDT

SEQ ID NO: 1491 - protein, 35 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (35)..(35): Pegylated
  MOD_RES (35)..(35): C-terminal alpha carboxylate replaced with amide
FTSDYSKYLDERRAKDFVQWLMDTGPSSGAPPPSC

SEQ ID NO: 1492 - protein, 24 aa, Artificial Sequence
  Synthetic Polypeptide
  MOD_RES (1)..(1): N-terminal amino group replaced with hydroxy group
  MOD_RES (1)..(1): Covalently attached to a C16 fatty acid
  MISC_FEATURE (11)..(15): Lactam bridge connection residues 11 and 15
  MOD_RES (24)..(24): C-terminal alpha carboxylate replaced with amide
FTSDYSKYLDERRAKDFVQWLMDT

SEQ ID NO: 1493 - protein, 24 aa, Artificial Sequence
  Synthetic Polypeptide
  MOD_RES (1)..(1): N-terminal amino group replaced with hydroxy group
  MOD_RES (5)..(5): Linked to a C16 fatty acid via Glu residue
  MISC_FEATURE (11)..(15): Lactam bridge connecting residues 11 and 15
  MISC_FEATURE (15)..(15): Linked to a C16 fatty acid via Glu residue
  MOD_RES (24)..(24): C-terminal alpha carboxylate replaced with amide
FTSDKSKYLDERRAKDFVQWLMDT

SEQ ID NO: 1494 - protein, 24 aa, Artificial Sequence
  Synthetic Polypeptide
  MOD_RES (1)..(1): N-terminal amino group replaced with hydroxy group
  MISC_FEATURE (15)..(15): Linked to C16 fatty acid via Glu residue
  MOD_RES (24)..(24): C-terminal alpha carboxylate replaced with amide
FTSDYSKYLDERRAKDFVQWLMDT

SEQ ID NO: 1495 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MISC_FEATURE (19)..(19): Linked to a C16 fatty acid via Glu residue
  MOD_RES (24)..(24): C-terminal alpha carboxylate replaced with amide
FTSDYSKYLDERRAKDFVKWLMDT

SEQ ID NO: 1496 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MISC_FEATURE (24)..(24): Linked to a C16 fatty acid via Glu residue
  MOD_RES (24)..(24): C-terminal alpha carboxylate replaced with amide
FTSDYSKYLDERRAKDFVQWLMDK

SEQ ID NO: 1497 - protein, 24 aa, Artificial Sequence
  Synthetic Polypeptide
  MOD_RES (1)..(1): N-terminal amino group replaced with hydroxy group
  MISC_FEATURE (11)..(11): Xaa is amino isobutyric acid
  MOD_RES (24)..(24): C-terminal alpha carboxylate replaced with amide
FTSDYSKYLDXRRAQDFVQWLMNT

SEQ ID NO: 1498 - protein, 24 aa, Artificial Sequence
  Synthetic Polypeptide
  MOD_RES (1)..(1): N-terminal amino group replaced with hydroxy group
  MISC_FEATURE (11)..(11)
  MISC_FEATURE (15)..(15): Xaa is alpha isobutyric acid
  MOD_RES (24)..(24): C-terminal alpha carboxylate replaced with amide
FTSDKSKYLDXRRAXDFVCWLMNT

SEQ ID NO: 1499 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate replaced with amide
FTSDYSKYLDERRAQDFVQWLMNT

SEQ ID NO: 1500 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate replaced with amide
FTSDKSKYLDERRAQDFVCWLMNT

SEQ ID NO: 1501 - protein, 24 aa, Artificial Sequence
  Synthetic Polypeptide
  MISC_FEATURE (4)..(7): Lactam bridge connecting residues 4 and 7
  MOD_RES (11)..(11): Xaa is alpha isobutyric acid
  MOD_RES (24)..(24): C-terminal carboxylate replaced with amide
FTSEYSKYLDXRRAQDFVQWLMNT

SEQ ID NO: 1502 - protein, 24 aa, Artificial Sequence
  Synthetic Polypeptide
  MISC_FEATURE (4)..(7): Lactam bridge connecting residues 4 and 7
  MOD_RES (11)..(11): Xaa is alpha isobutyric acid
  MOD_RES (24)..(24): C-terminal carboxylate replaced with amide
FTSEYSKYLDXRRAQDFVQWLMNT

SEQ ID NO: 1503 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDERRAKEFVQWLMDT

SEQ ID NO: 1504 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate replaced with amide
FTSDYSKYLDEQAAKEFIAWLMNT

SEQ ID NO: 1505 - protein, 34 aa, Artificial Sequence; identical to SEQ ID NO: 1430
  Synthetic Polypeptide
  MOD_RES (34)..(34): C-terminal alpha carboxylate replaced with amide

SEQ ID NO: 1506 - protein, 24 aa, Artificial Sequence
  Synthetic Polypeptide
  MOD_RES (1)..(1): N-terminal amino group replaced with hydroxy group
  MISC_FEATURE (5)..(5): Linked to a C16 fatty acid via Glu residue
  MISC_FEATURE (7)..(7): Linked to a C16 fatty acid via Glu residue
  MOD_RES (24)..(24): C-terminal carboxylate replaced with amide
FTSDKSKYLDERRAKDFVQWLMDT

SEQ ID NO: 1507 - protein, 6 aa, Artificial Sequence
  Synthetic Polypeptide
  MISC_FEATURE (1)..(1): Xaa1 is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, valine, glycine, N-methyl serine, and aminoisobutyric acid (AIB)
  MISC_FEATURE (3)..(3): Xaa is selected from a group consisting of Glu or Gln
XXXTGF

SEQ ID NO: 1508 - protein, 5 aa, Artificial Sequence
  Synthetic Polypeptide
  MISC_FEATURE (1)..(1): Xaa is selected from a group consisting of Ser, D-serine, D-alanine, valine, glycine, N-methyl serine, and aminoisobutyric acid (AIB)
  MISC_FEATURE (2)..(2): Xaa is selected from a group consisting of Glu or Gln
XXTGF

SEQ ID NO: 1509 - protein, 4 aa, Artificial Sequence
  Synthetic Polypeptide
  MISC_FEATURE (1)..(1): Xaa is selected from a group consisting of Glu or Gln
XTGF

SEQ ID NO: 1510 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate replaced with amide
FTSDYSKYLDSRRAQDFVQWLMDT

SEQ ID NO: 1511 - protein, 28 aa, Artificial Sequence
  Synthetic Polypeptide
  MOD_RES (28)..(28): C-terminal alpha carboxylate replaced with amide
SQGTFTSEYSKYLDSRRAQDFVQWLMNT

SEQ ID NO: 1512 - protein, 28 aa, Artificial Sequence
  Synthetic Polypeptide
  MISC_FEATURE (4)..(5): Threonine at position 4 and phenyl lactic acid at position 5 linked via ester bond
  MISC_FEATURE (5)..(5): Xaa is phenyl lactic acid
  MOD_RES (28)..(28): C-terminal alpha carboxylate replaced with amide
SQGTXTSEYSKYLDSRRAQDFVQWLMNT

SEQ ID NO: 1513 - protein, 29 aa, Artificial Sequence
  Synthetic Polypeptide
  MISC_FEATURE (5)..(6): Threorine at position 5 and phenyl lactic acid at position 6 linked via ester bond
  MISC_FEATURE (6)..(6): Xaa is phenyl lactic acid
  MOD_RES (29)..(29): C-terminal alpha carboxylate replaced with amide
HSQGTXTSEYSKYLDSRRAQDFVQWLMNT

SEQ ID NO: 1514 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (19)..(19): Pegylated
  MOD_RES (24)..(24): C-terminal alpha carboxylate replaced with amide
FTSEYSKYLDERRAKDFVCWLMNT

SEQ ID NO: 1515 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MISC_FEATURE (19)..(19): Pegylated via spacer
  MOD_RES (24)..(24): C-terminal alpha carboxylate replaced with amide
FTSDYSKYLDERRAKDFVKWLMDT

SEQ ID NO: 1516 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (19)..(19): Pegylated via rigid spacer
  MOD_RES (24)..(24): C-terminal alpha carboxylate replaced with amide
FTSDYSKYLDERRAKDFVKWLMDT

SEQ ID NO: 1517 - protein, 35 aa, Artificial Sequence
  Synthetic Polypeptide
  MISC_FEATURE (1)..(1): N-terminal amino group replaced with hydroxy group
  MISC_FEATURE (11)..(15): Lactam bridge connecting residues 11 and 15
  MOD_RES (35)..(35): Pegylated
  MOD_RES (35)..(35): C-terminal alpha carboxylate replaced with amide
FTSDYSKYLDERRAKDFVQWLMDTGPGPGPGPGPC

SEQ ID NO: 1518 - protein, 35 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (35)..(35): Pegylated
  MOD_RES (35)..(35): C-terminal alpha carboxylate reaplaced with amide
FTSDYSKYLDERRAKDFVQWLMDGGPSSGAPPPSC

SEQ ID NO: 1519-1700 - skipped (182 entries)

SEQ ID NO: 1701 - protein, 29 aa, Artificial Sequence
  Synthetic peptide
  MOD_RES (2)..(2): Xaa is AIB
  misc_feature (16)..(16): Xaa can be any naturally occurring amino acid
  misc_feature (20)..(20): Xaa can be any naturally occurring amino acid
  MOD_RES (29)..(29): C-terminal amidation
HSQGTFTSDYSKYLDXQAAXGFIAWLMNT

SEQ ID NO: 1702 - protein, 29 aa, Artificial Sequence
  Synthetic peptide
  MOD_RES (2)..(2): Xaa is AIB
  MOD_RES (10)..(10): Acylated with C16 fatty acyl group
  MOD_RES (16)..(16): Xaa is AIB
  MOD_RES (29)..(29): C-terminal amidation
HXQGTFTSDKSKYLDXRAAQDFVQWLMDT

SEQ ID NO: 1703 - protein, 29 aa, Artificial Sequence
  Synthetic peptide
  MOD_RES (2)..(2): Xaa is AIB
  MOD_RES (10)..(10): Acylated with C14 fatty acyl group via dipeptide spacer
  MOD_RES (16)..(16): Xaa is AIB
  MOD_RES (29)..(29): C-terminal amidation
HXQGTFTSDKSKYLDXRAAQDFVQWLMDT

SEQ ID NO: 1704 - protein, 29 aa, Artificial Sequence
  Synthetic peptide
  MOD_RES (2)..(2): Xaa is AIB
  MOD_RES (10)..(10): Acylated with C18 fatty acyl group via dipeptide spacer
  MOD_RES (16)..(16): Xaa is AIB
  MOD_RES (29)..(29): C-terminal amidation
HXQGTFTSDKSKYLDXRAAQDFVQWLMDT

SEQ ID NO: 1705 - protein, 29 aa, Artificial Sequence
  Synthetic peptide
  MOD_RES (1)..(10): Acylated with C16 fatty acyl group via dipeptide spacer
  MOD_RES (2)..(2): Xaa is AIB
  MOD_RES (16)..(16): Xaa is AIB
  MOD_RES (29)..(29): C-terminal amidation
HXEGTFTSDKSKYLDXRAAQDFVQWLMDT

SEQ ID NO: 1706 - protein, 29 aa, Artificial Sequence
  Synthetic peptide
  MOD_RES (2)..(2): Xaa is AIB
  MOD_RES (10)..(10): Acylated with C16 fatty acyl group via dipeptide spacer
  MOD_RES (16)..(16): Xaa is AIB
HXQGTFISDKSKYLDXRAAQDFVQWLMDT

SEQ ID NO: 1707 - protein, 29 aa, Artificial Sequence
  Synthetic peptide
  MOD_RES (2)..(2): Xaa is AIB
  MOD_RES (10)..(10): Acylated with C16 fatty acyl group via dipeptide spacer
  MOD_RES (29)..(29): C-terminal amidation
HXQGTFTSDKSKYLDERAAQDFVQWLMDT

SEQ ID NO: 1708 - protein, 29 aa, Artificial Sequence
  Synthetic peptide
  MOD_RES (2)..(2): Xaa is AIB
  MOD_RES (10)..(10): Acylated with C16 fatty acyl group via dipeptide spacer
  MOD_RES (16)..(16): Xaa is AIB
  MOD_RES (29)..(29): C-terminal amidation
HXQGTFTSDKSKYLEXRAAQDFVQWLMDT

SEQ ID NO: 1709 - protein, 29 aa, Artificial Sequence
  Synthetic peptide
  MOD_RES (2)..(2): d-Ser
  MOD_RES (10)..(10): Acylated with C16 fatty acyl group via dipeptide spacer
  MOD_RES (16)..(16): Xaa is AIB
  MOD_RES (29)..(29): C-terminal amidation
HSQGTFTSDKSKYLDXRAAQDFVQWLMDT

SEQ ID NO: 1710 - protein, 29 aa, Artificial Sequence
  Synthetic peptide
  MOD_RES (2)..(2): Xaa is AIB
  MOD_RES (10)..(10): Acylated with C16 fatty acyl group via dipeptide spacer
  MOD_RES (16)..(16): Xaa is AIB
  MOD_RES (29)..(29): C-terminal amidation
HXQGTFTSDKSKYLDXRAAQDFVQWLLDT

SEQ ID NO: 1711 - protein, 29 aa, Artificial Sequence
  Synthetic peptide
  MOD_RES (2)..(2): Xaa is AIB
  MOD_RES (10)..(10): Acylated with C16 fatty acyl group via dipeptide spacer
  MOD_RES (29)..(29): C-terminal amidation
HXQGTFTSDKSKYLDEQAAKEFIAWLLDT

SEQ ID NO: 1712 - protein, 29 aa, Artificial Sequence
  Synthetic peptide
  MOD_RES (2)..(2): Xaa is AIB
  MOD_RES (10)..(10): Acylated with C16 fatty acyl group via gamma-Glu spacer
  MOD_RES (29)..(29): C-terminal amidation
HXQGTFTSDKSKYLDEQAAKEFICWLLDT

SEQ ID NO: 1713 - protein, 29 aa, Artificial Sequence
  Synthetic peptide
  MOD_RES (2)..(2): Xaa is AIB
  MOD_RES (10)..(10): Acylated with C16 fatty acyl group via gamma-Glu spacer
  MOD_RES (24)..(24): PEGYLATION
  MOD_RES (29)..(29): C-terminal amidation
HXQGTFTSDKSKYLDEQAAKEFICWLLDT

SEQ ID NO: 1714 - protein, 29 aa, Artificial Sequence
  Synthetic peptide
  MOD_RES (2)..(2): Xaa is AIB
  MOD_RES (10)..(10): Acylated with C16 fatty acyl group via gamma-Glu spacer
  MOD_RES (24)..(24): PEGYLATION
  MOD_RES (29)..(29): C-terminal amidation
HXQGTFTSDKSKYLDERAAQDFVCWLLDT

SEQ ID NO: 1715 - protein, 30 aa, Artificial Sequence
  Synthetic peptide
  MOD_RES (2)..(2): Xaa is AIB
  MOD_RES (10)..(10): Acylated with C16 fatty acyl group via gamma-Glu spacer
  MOD_RES (30)..(30): PEGYLATION
  MOD_RES (30)..(30): C-terminal amidation
HXQGTFTSDKSKYLDEQAAKEFIQWLLDTC

SEQ ID NO: 1716 - protein, 29 aa, Artificial Sequence
  Synthetic peptide
  MOD_RES (10)..(10): Acylated with C16 fatty acyl group via gamma-Glu spacer
  MOD_RES (24)..(24): PEGYLATION
  MOD_RES (29)..(29): C-terminal amidation
HAQGTFTSDKSKYLDERAAQDFVCWLLDT

SEQ ID NO: 1717 - protein, 29 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (29)..(29): C-terminal amidation
HSQGTFTSDKSKYLDEQAAKEFICWLLDT

SEQ ID NO: 1718 - protein, 29 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (29)..(29): C-terminal amidation
HSQGTFTSDKSKYLDERAAQDFVQWLLDT

SEQ ID NO: 1719 - protein, 29 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (29)..(29): C-terminal amidation
HSQGTFTSDKSKYLDERAAQDFVCWLLDT

SEQ ID NO: 1720 - protein, 29 aa, Artificial Sequence
  Synthetic peptide
  MOD_RES (2)..(2): d-Ser
  MOD_RES (10)..(10): Acylated with C16 fatty acyl group via gamma-Glu spacer
HSQGTFTSDKSKYLDEQAAKEFICWLLDT

SEQ ID NO: 1721 - protein, 31 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (31)..(31): C-terminal amidation
HSQGTFTSDKSKYLDEQAAKEFICWLLDTGE

SEQ ID NO: 1722 - protein, 31 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (24)..(24): PEGYLATION
HSQGTFTSDKSKYLDEQAAKEFICWLLDTGG

SEQ ID NO: 1723 - protein, 29 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (24)..(24): PEGYLATION
  MOD_RES (29)..(29): C-terminal amidation
HSQGTFTSDKSKYLDERAAQDFVCWLLDT

SEQ ID NO: 1724 - protein, 30 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (30)..(30): PEGYLATION
  MOD_RES (30)..(30): C-terminal amidation
HSQGTFTSDKSKYLDERAAQDFVQWLLDTC

SEQ ID NO: 1725 - protein, 30 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (24)..(24): PEGYLATION
  MOD_RES (30)..(30): C-terminal amidation
HSQGTFTSDYSKYLDSRRAQDFVQWLMNTE

SEQ ID NO: 1726 - protein, 30 aa, Artificial Sequence
  Synthetic peptide
  MOD_RES (2)..(2): d-Ser
  MOD_RES (10)..(10): Acylated with C16 fatty acyl group via gamma-Glu spacer
  MOD_RES (24)..(24): PEGYLATION
HSQGTFTSDKSKYLDEQAAKEFICWLLDTC

SEQ ID NO: 1727 - protein, 29 aa, Artificial Sequence
  Synthetic peptide
  MOD_RES (1)..(1): Xaa is DMIA
  MOD_RES (10)..(10): Acylated with C16 fatty acyl group via gamma-Glu spacer
  MOD_RES (29)..(29): C-terminal amidation
XSQGTFTSDKSKYLDEQAAKEFICWLLDT

SEQ ID NO: 1728 - protein, 29 aa, Artificial Sequence
  Synthetic peptide
  MOD_RES (1)..(1): des-amino-His
  MOD_RES (10)..(10): Acylated with C16 fatty acyl group via gamma-Glu spacer
  MOD_RES (29)..(29): C-terminal amidation
HSQGTFTSDKSKYLDEQAAKEFICWLLDT

SEQ ID NO: 1729 - protein, 29 aa, Artificial Sequence
  Synthetic peptide
  MOD_RES (1)..(1): Ac-His
  MOD_RES (10)..(10): Acylated with C16 fatty acyl group via gamma-Glu spacer
  MOD_RES (24)..(24): PEGYLATION
  MOD_RES (29)..(29): C-terminal amidation
HSQGTFTSDKSKYLDEQAAKEFICWLLDT

SEQ ID NO: 1730 - protein, 29 aa, Artificial Sequence
  Synthetic peptide
  MOD_RES (2)..(2): Xaa is AIB
  MOD_RES (10)..(10): Acylated with C16 fatty acyl group via gamma-Glu spacer
  MOD_RES (29)..(29): C-terminal amidation
HXQGTFTSDKSKYLDEEAVRLFIEWLMNT

SEQ ID NO: 1731 - protein, 29 aa, Artificial Sequence
  Synthetic peptide
  MOD_RES (2)..(2): Xaa is AIB
  MOD_RES (10)..(10): Acylated with C16 fatty acyl group
  MOD_RES (29)..(29): C-terminal amidation
HXQGTFTSDKSKYLDEEAVRLFIEWLMNT

SEQ ID NO: 1732 - protein, 29 aa, Artificial Sequence
  Synthetic peptide
  MOD_RES (2)..(2): Xaa is AIB
  MOD_RES (24)..(24): PEGYLATION
  MOD_RES (29)..(29): C-terminal amidation
HXQGTFTSDYSKYLDEEAVRLFICWLMNT

SEQ ID NO: 1733 - protein, 29 aa, Artificial Sequence
  Synthetic peptide
  MOD_RES (2)..(2): Xaa is AIB
  MOD_RES (29)..(29): C-terminal amidation
HXQGTFTSDYSKYLDEEAVRLFIEWLMNT

SEQ ID NO: 1734 - protein, 29 aa, Artificial Sequence
  Synthetic peptide
  MOD_RES (2)..(2): Xaa is AIB
  MOD_RES (29)..(29): C-terminal amidation
HXQGTFTSDYSKYLDEEAVRLFICWLMNT

SEQ ID NO: 1735 - protein, 29 aa, Artificial Sequence
  Synthetic peptide
  MOD_RES (2)..(2): d-Ser
  MOD_RES (24)..(24): PEGYLATION
  MOD_RES (29)..(29): C-terminal amidation
HSQGTFTSDYSKYLDEEAVRLFICWLMNT

SEQ ID NO: 1736 - protein, 29 aa, Artificial Sequence
  Synthetic peptide
  MOD_RES (2)..(2): d-Ser
  MOD_RES (29)..(29): C-terminal amidation
HSQGTFTSDYSKYLDEEAVRLFIEWLMNT

SEQ ID NO: 1737 - protein, 29 aa, Artificial Sequence
  Synthetic peptide
  MOD_RES (2)..(2): d-Ser
  MOD_RES (29)..(29): C-terminal amidation
HSQGTFTSDYSKYLDEEAVRLFICWLMNT

SEQ ID NO: 1738 - protein, 29 aa, Artificial Sequence
  Synthetic peptide
  MOD_RES (10)..(10): Acylated with C16 fatty acyl group via acidic amino acid spacer
  MOD_RES (29)..(29): C-terminal amidation
HSQGTFTSDKSKYLDEEAVRLFIEWLMNT

SEQ ID NO: 1739 - protein, 29 aa, Artificial Sequence
  Synthetic peptide
  MOD_RES (10)..(10): Acylated with C16 fatty acyl group via gamma-Glu spacer
  MOD_RES (29)..(29): C-terminal amidation
HSQGTFTSDKSKYLDEEAVRLFIEWLMNT

SEQ ID NO: 1740 - protein, 29 aa, Artificial Sequence
  Synthetic peptide
  MOD_RES (2)..(2): Xaa is AIB
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HXQGTFTSDYSKYLDEKRAKEFVCWLMNT

SEQ ID NO: 1741 - protein, 29 aa, Artificial Sequence
  Synthetic peptide
  MOD_RES (2)..(2): Xaa is AIB
  MOD_RES (16)..(16): Xaa is AIB
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HXQGTFTSDYSKYLDXKRAKEFVCWLMNT

SEQ ID NO: 1742 - protein, 29 aa, Artificial Sequence
  Synthetic peptide
  MOD_RES (2)..(2): d-Ser
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HSQGTFTSDYSKYLDEKRAKEFVCWLMNT

SEQ ID NO: 1743 - protein, 29 aa, Artificial Sequence
  Synthetic peptide
  MOD_RES (2)..(2): d-Ser
  MOD_RES (16)..(16): Xaa is AIB
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HSQGTFTSDYSKYLDXKRAKEFVCWLMNT

SEQ ID NO: 1744 - protein, 29 aa, Artificial Sequence
  Synthetic peptide
  MOD_RES (2)..(2): d-Ser
  MISC_FEATURE (16)..(20): Salt bridge
  MISC_FEATURE (17)..(21): Salt bridge
  MOD_RES (29)..(29): C-terminal amidation
HSQGTFTSDYSKYLDEKRAKEFVQWLMNT

SEQ ID NO: 1745 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (16)..(16): Xaa is AIB
  MISC_FEATURE (16)..(20): Salt bridge
  MISC_FEATURE (17)..(21): Salt bridge
  MOD_RES (29)..(29): C-terminal amidation
HSQGTFTSDYSKYLDXKRAKEFVQWLMNT

SEQ ID NO: 1746 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via gamma-Glu spacer
  MISC_FEATURE (15)..(20): Salt bridge
  MOD_RES (16)..(16): Xaa is AIB
  MISC_FEATURE (16)..(21): Salt bridge
  MOD_RES (29)..(29): C-terminal amidation
HSQGTFTSDKSKYLDXKRAKEFVQWLMNT

SEQ ID NO: 1747 - protein, 29 aa, Artificial Sequence
  Synthetic peptide
  MOD_RES (1)..(1): Xaa is DMIA
  MOD_RES (16)..(16): Xaa is AIB
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
XSQGTFTSDYSKYLDXKRAKEFVCWLMNT

SEQ ID NO: 1748 - protein, 29 aa, Artificial Sequence
  Synthetic peptide
  MISC_FEATURE (16)..(20): Salt bridge
  MISC_FEATURE (17)..(21): Salt bridge
  MOD_RES (29)..(29): C-terminal amidation
HSQGTFTSDYSKYLDEKRAKEFVQWLMNT

SEQ ID NO: 1749 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via dipeptide spacer
  MOD_RES (16)..(16): Xaa is AIB
  MOD_RES (29)..(29): C-terminal amidation
HXQGTFTSDKSKYLDXRAAQDFVQWLMDT

SEQ ID NO: 1750 - protein, 29 aa, Artificial Sequence
  Synthetic peptide
  MOD_RES (2)..(2): Xaa is AIB
  MOD_RES (10)..(10): Acylated with C16 fatty acyl group via acidic amino acid spacer
  MOD_RES (29)..(29): C-terminal amidation
HXQGTFTSDKSKYLDEQAAKEFICWLLDT

SEQ ID NO: 1751 - protein, 29 aa, Artificial Sequence
  Synthetic peptide
  MOD_RES (2)..(2): Xaa is AIB
  MOD_RES (10)..(10): Acylated with C16 fatty acyl group via acidic amino acid spacer
  MOD_RES (24)..(24): PEGYLATION
  MOD_RES (29)..(29): C-terminal amidation
HXQGTFTSDKSKYLDEQAAKEFICWLLDT

SEQ ID NO: 1752 - protein, 29 aa, Artificial Sequence
  Synthetic peptide
  MOD_RES (2)..(2): Xaa is AIB
  MOD_RES (10)..(10): Acylated with C16 fatty acyl group via acidic amino acid spacer
  MOD_RES (24)..(24): PEGYLATION
  MOD_RES (29)..(29): C-terminal amidation
HXQGTFTSDKSKYLDERAAQDFVCWLLDT

SEQ ID NO: 1753 - protein, 30 aa, Artificial Sequence; identical to SEQ ID NO: 1715
  Synthetic peptide
  MOD_RES (2)..(2): Xaa is AIB
  MOD_RES (10)..(10): Acylated with C16 fatty acyl group via acidic amino acid spacer
  MOD_RES (30)..(30): PEGYLATION
  MOD_RES (30)..(30): C-terminal amidation

SEQ ID NO: 1754 - protein, 29 aa, Artificial Sequence
  Synthetic peptide
  MOD_RES (10)..(10): Acylated with C16 fatty acyl group via acidic amino acid spacer
  MOD_RES (24)..(24): PEGYLATION
  MOD_RES (29)..(29): C-terminal amidation
HAQGTFTSDKSKYLDERAAQDFVCWLLDT

SEQ ID NO: 1755 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (29)..(29): C-terminal amidation
HXQGTFTSDKSKYLDEQAAKEFICWLLDT

SEQ ID NO: 1756 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (29)..(29): C-terminal amidation
HXQGTFTSDKSKYLDERAAQDFVQWLLDT

SEQ ID NO: 1757 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (29)..(29): C-terminal amidation
HXQGTFTSDKSKYLDERAAQDFVCWLLDT

SEQ ID NO: 1758 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
HXQGTFTSDKSKYLDEQAAKEFICWLLDT

SEQ ID NO: 1759 - protein, 31 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (31)..(31): C-terminal amidation
HXQGTFTSDKSKYLDEQAAKEFICWLLDTGE

SEQ ID NO: 1760 - protein, 31 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (24)..(24): PEGYLATION
HXQGTFTSDKSKYLDEQAAKEFICWLLDTGG

SEQ ID NO: 1761 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (24)..(24): PEGYLATION
  MOD_RES (29)..(29): C-terminal amidation
HXQGTFTSDKSKYLDERAAQDFVCWLLDT

SEQ ID NO: 1762 - protein, 30 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (30)..(30): PEGYLATION
  MOD_RES (30)..(30): C-terminal amidation
HXQGTFTSDKSKYLDERAAQDFVQWLLDTC

SEQ ID NO: 1763 - protein, 30 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (24)..(24): PEGYLATION
  MOD_RES (30)..(30): C-terminal amidation
HXQGTFTSDYSKYLDSRRAQDFVQWLMNTE

SEQ ID NO: 1764 - protein, 30 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MOD_RES (24)..(24): PEGYLATION
HXQGTFTSDKSKYLDEQAAKEFICWLLDTC

SEQ ID NO: 1765 - protein, 29 aa, Artificial Sequence
  Synthetic peptide
  MOD_RES (1)..(1): Xaa is DMIA
  MOD_RES (10)..(10): Acylated with C16 fatty acyl group via acidic amino acid spacer
  MOD_RES (29)..(29): C-terminal amidation
XSQGTFTSDKSKYLDEQAAKEFICWLLDT

SEQ ID NO: 1766 - protein, 29 aa, Artificial Sequence
  Synthetic peptide
  MOD_RES (1)..(1): des-amino-His
  MOD_RES (10)..(10): Acylated with C16 fatty acyl group via acidic amino acid spacer
  MOD_RES (29)..(29): C-terminal amidation
HSQGTFTSDKSKYLDEQAAKEFICWLLDT

SEQ ID NO: 1767 - protein, 29 aa, Artificial Sequence
  Synthetic peptide
  MOD_RES (1)..(1): Ac-His
  MOD_RES (10)..(10): Acylated with C16 fatty acyl group via acidic amino acid spacer
  MOD_RES (24)..(24): PEGYLATION
  MOD_RES (29)..(29): C-terminal amidation
HSQGTFTSDKSKYLDEQAAKEFICWLLDT

SEQ ID NO: 1768 - protein, 29 aa, Artificial Sequence
  Synthetic peptide
  MOD_RES (2)..(2): Xaa is AIB
  MOD_RES (10)..(10): Acylated with C16 fatty acyl group via acidic amino acid spacer
  MOD_RES (29)..(29): C-terminal amidation
HXQGTFTSDKSKYLDEEAVRLFIEWLMNT

SEQ ID NO: 1769 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (24)..(24): PEGYLATION
  MOD_RES (29)..(29): C-terminal amidation
HXQGTFTSDYSKYLDEEAVRLFICWLMNT

SEQ ID NO: 1770 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (29)..(29): C-terminal amidation
HXQGTFTSDYSKYLDEEAVRLFIEWLMNT

SEQ ID NO: 1771 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (29)..(29): C-terminal amidation
HXQGTFTSDYSKYLDEEAVRLFICWLMNT

SEQ ID NO: 1772 - protein, 29 aa, Artificial Sequence
  Synthetic peptide
  MOD_RES (10)..(10): Acylated with C16 fatty acyl group via acidic amino acid spacer
  MOD_RES (29)..(29): C-terminal amidation
HSQGTFTSDKSKYLDEEAVRLFIEWLMNT

SEQ ID NO: 1773 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HXQGTFTSDYSKYLDEKRAKEFVCWLMNT

SEQ ID NO: 1774 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (16)..(16): Xaa is AIB
  MISC_FEATURE (16)..(20): Salt bridge
  MISC_FEATURE (17)..(21): Salt bridge
  MOD_RES (24)..(24): PEGYLATION
  MOD_RES (29)..(29): C-terminal amidation
HSQGTFTSDYSKYLDXKRAKEFVCWLMNT

SEQ ID NO: 1775 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MISC_FEATURE (16)..(20): Salt bridge
  MISC_FEATURE (17)..(21): Salt bridge
  MOD_RES (29)..(29): C-terminal amidation
HSQGTFTSDYSKYLDEKRAKEFVQWLMNT

SEQ ID NO: 1776 - protein, 29 aa, Artificial Sequence
  Synthetic peptide
  MOD_RES (2)..(2): D-serine, D-alanine, valine, amino n-butyric acid, glycine, N-methyl serine, aminoisobutyric acid
  MOD_RES (10)..(10): Acylated with C16 fatty acyl group via acidic amino acid spacer
  MISC_FEATURE (15)..(20): Salt bridge
  MOD_RES (16)..(16): Xaa is AIB
  MISC_FEATURE (16)..(21): Salt bridge
  MOD_RES (29)..(29): C-terminal amidation
HSQGTFTSDKSKYLDXKRAKEFVQWLMNT

SEQ ID NO: 1777-1800 - skipped (24 entries)

SEQ ID NO: 1801 - protein, 37 aa, Homo sapiens
HSQGTFTSDYSKYLDSRRAQDFVQWLMNTKRNRNNIA

SEQ ID NO: 1802 - protein, 37 aa, Artificial Sequence
  OXM analog
HSEGTFTSDYSKYLDSRRAQDFVQWLMNTKRNRNNIA

SEQ ID NO: 1803 - protein, 37 aa, Artificial Sequence
  OXM analog
HSDGTFTSDYSKYLDSRRAQDFVQWLMNTKRNRNNIA

SEQ ID NO: 1804 - protein, 38 aa, Artificial Sequence
  OXM analog
  MOD_RES (2)..(2): Xaa=Aminoisobutyric acid
  MOD_RES (38)..(38): C-terminal amidation
HXQGTFTSDYSKYLDSRRAQDFVQWLMNTKRNRNNIAC

SEQ ID NO: 1805 - protein, 38 aa, Artificial Sequence
  OXM analog
  MOD_RES (2)..(2): Xaa=D-serine
  MOD_RES (38)..(38): Xaa=Cys(mPEG)5kDa
  MOD_RES (38)..(38): C-terminal amidation
HXQGTFTSDYSKYLDSRRAQDFVQWLMNTKRNRNNIAX

SEQ ID NO: 1806 - protein, 38 aa, Artificial Sequence; identical to SEQ ID NO: 1805
  OXM analog
  MOD_RES (2)..(2): Xaa=D-serine
  MOD_RES (38)..(38): Xaa=Cys(mPEG)20kDa
  MOD_RES (38)..(38): C-terminal amidation

SEQ ID NO: 1807 - protein, 38 aa, Artificial Sequence; identical to SEQ ID NO: 1805
  OXM analog
  MOD_RES (2)..(2): Xaa=D-serine
  MOD_RES (38)..(38): Xaa=Cys(mPEG)2 40kDa
  MOD_RES (38)..(38): C-terminal amidation

SEQ ID NO: 1808 - protein, 38 aa, Artificial Sequence; identical to SEQ ID NO: 1805
  OXM analog
  MOD_RES (2)..(2): Xaa=D-serine
  MOD_RES (38)..(38): Xaa=Cys(9cholest-5-en-3-yl{[(2R)-3-amino-2-(amino) -3-oxopropyl]thio}acetate)
  MOD_RES (38)..(38): C-terminal amidation

SEQ ID NO: 1809 - protein, 38 aa, Artificial Sequence; identical to SEQ ID NO: 1805
  OXM analog
  MOD_RES (2)..(2): Xaa=Aminoisobutyric acid
  MOD_RES (38)..(38): Xaa=Cys(mPEG)5kDa
  MOD_RES (38)..(38): C-terminal amidation

SEQ ID NO: 1810 - protein, 38 aa, Artificial Sequence; identical to SEQ ID NO: 1805
  OXM analog
  MOD_RES (2)..(2): Xaa=aminoisobutyric acid
  MOD_RES (38)..(38): Xaa=Cys(mPEG)20kDa
  MOD_RES (38)..(38): C-terminal amidation

SEQ ID NO: 1811 - protein, 38 aa, Artificial Sequence; identical to SEQ ID NO: 1805
  OXM analog
  MOD_RES (2)..(2): X=aminoisobutyric acid
  MOD_RES (38)..(38): Xaa=Cys(mPEG)2 40kDa
  MOD_RES (38)..(38): C-terminal amidation

SEQ ID NO: 1812 - protein, 38 aa, Artificial Sequence; identical to SEQ ID NO: 1805
  OXM analog
  MOD_RES (2)..(2): Xaa=aminoisobutyric acid
  MOD_RES (38)..(38): Xaa=Cys(cholest-5-en-3-yl{[(2R)-3-amino-2-(amino)- 3-oxopropyl]thio}acetate)
  MOD_RES (38)..(38): C-terminal amidation

SEQ ID NO: 1813 - protein, 38 aa, Artificial Sequence
  OXM analog
  MOD_RES (2)..(2): Xaa=aminoisobutyric acid
  MOD_RES (27)..(27): Xaa=methionine sulfoxide
  MOD_RES (38)..(38): Xaa=Cys(mPEG)240kDa
  MOD_RES (38)..(38): C-terminal amidation
HXQGTFTSDYSKYLDSRRAQDFVQWLXNTKRNRNNIAX

SEQ ID NO: 1814 - protein, 38 aa, Artificial Sequence; identical to SEQ ID NO: 1813
  OXM analog
  MOD_RES (2)..(2): Xaa=Aib
  MOD_RES (27)..(27): Xaa=methionine sulfoxide
  MOD_RES (38)..(38): Xaa=Cys(mPEG)260kDa
  MOD_RES (38)..(38): C-terminal amidation

SEQ ID NO: 1815 - protein, 37 aa, Artificial Sequence
  OXM analog
  MOD_RES (2)..(2): Xaa=Aib
  MOD_RES (20)..(20): Xaa=Cys(mPEG)240kDa
  MOD_RES (37)..(37): C-terminal amidation
HXQGTFTSDYSKYLDSRRAXDFVQWLMNTKRNRNNIA

SEQ ID NO: 1816 - protein, 37 aa, Artificial Sequence
  OXM analog
  MOD_RES (2)..(2): Xaa=Aib
  MOD_RES (21)..(21): Xaa=Cys(mPEG)240kDa
  MOD_RES (37)..(37): C-terminal amidation
HXQGTFTSDYSKYLDSRRAQXFVQWLMNTKRNRNNIA

SEQ ID NO: 1817 - protein, 37 aa, Artificial Sequence
  OXM analog
  MOD_RES (2)..(2): Aib
  MOD_RES (24)..(24): Xaa=Cys(mPEG)240kDa
  MOD_RES (27)..(27): Xaa=metionine sulfoxide
  MOD_RES (37)..(37): C-terminal amidation
HXQGTFTSDYSKYLDSRRAQDFVXWLXNTKRNRNNIA

SEQ ID NO: 1818 - protein, 37 aa, Artificial Sequence
  OXM analog
  MOD_RES (2)..(2): Xaa=Aib
  MOD_RES (28)..(28): Xaa=Cys(mPEG)240kDa
  MOD_RES (37)..(37): C-terminal amidation
HXQGTFTSDYSKYLDSRRAQDFVQWLMXTKRNRNNIA

SEQ ID NO: 1819 - protein, 38 aa, Artificial Sequence; identical to SEQ ID NO: 1805
  OXM analog
  MOD_RES (2)..(2): Xaa=D-serine
  MOD_RES (38)..(38): Xaa=Lys(palmitoyl)
  MOD_RES (38)..(38): C-terminal amidation

SEQ ID NO: 1820 - protein, 38 aa, Artificial Sequence
  OXM analog
  MOD_RES (1)..(1): Xaa=desamino-His (deltaNH2-H)
  MOD_RES (2)..(2): Xaa=Aib
  MOD_RES (27)..(27): Xaa=mrtionine sulfoxide
  MOD_RES (38)..(38): Xaa=Cys(mPEG)240kDa
  MOD_RES (38)..(38): C-terminal amidation
XXQGTFTSDYSKYLDSRRAQDFVQWLXNTKRNRNNIAX

SEQ ID NO: 1821 - protein, 38 aa, Artificial Sequence; identical to SEQ ID NO: 1805
  OXM analog
  MOD_RES (2)..(2): xaa=D-serine
  MOD_RES (38)..(38): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (38)..(38): C-terminal amidation

SEQ ID NO: 1822 - protein, 37 aa, Artificial Sequence
  OXM analog
  MOD_RES (2)..(2): Xaa=Aib
  MOD_RES (11)..(11): Xaa=Cys(mPEG)240kDa
  MOD_RES (27)..(27): Xaa=methionine sulfoxide
  MOD_RES (37)..(37): C-terminal amidation
HXQGTFTSDYXKYLDSRRAQDFVQWLXNTKRNRNNIA

SEQ ID NO: 1823 - protein, 37 aa, Artificial Sequence
  OXM analog
  MOD_RES (2)..(2): Xaa=Aib
  MOD_RES (12)..(12): Xaa=Cys(mPEG)240kDa
  MOD_RES (27)..(27): Xaa=Methionine sulfoxide
  MOD_RES (37)..(37): C-terminal amidation
HXQGTFTSDYSXYLDSRRAQDFVQWLXNTKRNRNNIA

SEQ ID NO: 1824 - protein, 38 aa, Artificial Sequence; identical to SEQ ID NO: 1805
  OXM analog
  MOD_RES (2)..(2): Xaa=Aib
  MOD_RES (38)..(38): Xaa=Lys(palmitoyl)
  MOD_RES (38)..(38): C-terminal amidation

SEQ ID NO: 1825 - protein, 38 aa, Artificial Sequence
  OXM analog
  MOD_RES (2)..(2): Xaa=Aib
  MOD_RES (27)..(27): Xaa=Nle
  MOD_RES (38)..(38): C-terminal amidation
HXQGTFTSDYSKYLDSRRAQDFVQWLXNTKRNRNNIAC

SEQ ID NO: 1826 - protein, 38 aa, Artificial Sequence; identical to SEQ ID NO: 1825
  OXM analog
  MOD_RES (2)..(2): Xaa=Aib
  MOD_RES (27)..(27): Xaa=O-methyl-L-homoserine
  MOD_RES (38)..(38): C-terminal amidation

SEQ ID NO: 1827 - protein, 38 aa, Artificial Sequence; identical to SEQ ID NO: 1813
  OXM analog
  MOD_RES (2)..(2): Xaa=Aib
  MOD_RES (27)..(27): Xaa=Nle
  MOD_RES (38)..(38): Xaa=Cys(cholest-5-en-3-yl{[(2R)-3-amino-2-(amino)- 3-oxopropyl]thio}acetate)
  MOD_RES (38)..(38): C-terminal amidation

SEQ ID NO: 1828 - protein, 38 aa, Artificial Sequence; identical to SEQ ID NO: 1813
  OXM analog
  MOD_RES (2)..(2): Xaa=Aib
  MOD_RES (27)..(27): Xaa=O-methyl-L-homoserine
  MOD_RES (38)..(38): Xaa=Cys(cholest-5-en-3-yl{[(2R)-3-amino-2-(amino)- 3-oxopropyl]thio}acetate)
  MOD_RES (38)..(38): C-terminal amidation

SEQ ID NO: 1829 - protein, 38 aa, Artificial Sequence; identical to SEQ ID NO: 1805
  OXM analog
  MOD_RES (2)..(2): Xaa=Aib
  MOD_RES (38)..(38): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (38)..(38): C-terminal amidation

SEQ ID NO: 1830 - protein, 38 aa, Artificial Sequence; identical to SEQ ID NO: 1804
  OXM analog
  MOD_RES (2)..(2): Xaa=D-serine
  MOD_RES (38)..(38): C-terminal amidation

SEQ ID NO: 1831 - protein, 38 aa, Artificial Sequence; identical to SEQ ID NO: 1813
  OXM analog
  MOD_RES (2)..(2): Xaa=D-serine
  MOD_RES (27)..(27): Xaa=metionine sulfoxide
  MOD_RES (38)..(38): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (38)..(38): C-terminal amidation

SEQ ID NO: 1832 - protein, 38 aa, Artificial Sequence; identical to SEQ ID NO: 1813
  OXM analog
  MOD_RES (2)..(2): Xaa=D-serine
  MOD_RES (27)..(27): Xaa=methionine sulfoxide
  MOD_RES (38)..(38): Xaa=Cys(CH2CONH2)
  MOD_RES (38)..(38): C-terminal amidation

SEQ ID NO: 1833 - protein, 37 aa, Artificial Sequence
  OXM analog
  MOD_RES (2)..(2): Xaa=1-Amino-1-cyclohexane carboxylic acid
  MOD_RES (37)..(37): C-terminal amidation
HXQGTFTSDYSKYLDSRRAQDFVQWLMNTKRNRNNIA

SEQ ID NO: 1834 - protein, 37 aa, Artificial Sequence; identical to SEQ ID NO: 1833
  OXM analog
  MOD_RES (2)..(2): Xaa=Abu
  MOD_RES (37)..(37): C-terminal amidation

SEQ ID NO: 1835 - protein, 37 aa, Artificial Sequence; identical to SEQ ID NO: 1833
  OXM analog
  MOD_RES (2)..(2): Xaa=D-abu
  MOD_RES (37)..(37): C-terminal amidation

SEQ ID NO: 1836 - protein, 37 aa, Artificial Sequence; identical to SEQ ID NO: 1833
  OXM analog
  MOD_RES (2)..(2): Xaa=Nva (Aminovaleric acid)
  MOD_RES (37)..(37): C-terminal amidation

SEQ ID NO: 1837 - protein, 37 aa, Artificial Sequence; identical to SEQ ID NO: 1833
  OXM analog
  MOD_RES (2)..(2): Xaa= beta-cyclopropyl-alanine
  MOD_RES (37)..(37): C-terminal amidation

SEQ ID NO: 1838 - protein, 37 aa, Artificial Sequence; identical to SEQ ID NO: 1833
  OXM analog
  MOD_RES (2)..(2): Xaa=propargylglycine
  MOD_RES (37)..(37): C-terminal amidation

SEQ ID NO: 1839 - protein, 37 aa, Artificial Sequence; identical to SEQ ID NO: 1833
  OXM analog
  MOD_RES (2)..(2): Xaa=Allylglycine
  MOD_RES (37)..(37): C-terminal amidation

SEQ ID NO: 1840 - protein, 37 aa, Artificial Sequence; identical to SEQ ID NO: 1833
  OXM analog
  MOD_RES (2)..(2): Xaa=2-Amino-2-cyclohexyl-propanoic acid
  MOD_RES (37)..(37): C-terminal amidation

SEQ ID NO: 1841 - protein, 37 aa, Artificial Sequence; identical to SEQ ID NO: 1833
  OXM analog
  MOD_RES (2)..(2): Xaa=D-tertbutylglycine
  MOD_RES (37)..(37): C-terminal amidation

SEQ ID NO: 1842 - protein, 37 aa, Artificial Sequence; identical to SEQ ID NO: 1833
  OXM analog
  MOD_RES (2)..(2): Xaa=Vinylglycine
  MOD_RES (37)..(37): C-terminal amidation

SEQ ID NO: 1843 - protein, 37 aa, Artificial Sequence; identical to SEQ ID NO: 1833
  OXM analog
  MOD_RES (2)..(2): Xaa=1-Amino-1-cyclopropane carboxylic acid
  MOD_RES (37)..(37): C-terminal amidation

SEQ ID NO: 1844 - protein, 37 aa, Artificial Sequence; identical to SEQ ID NO: 1833
  OXM analog
  MOD_RES (2)..(2): Xaa=1-Amino-1-cyclobutane carboxylic acid
  MOD_RES (37)..(37): C-terminal amidation

SEQ ID NO: 1845 - protein, 37 aa, Artificial Sequence; identical to SEQ ID NO: 1833
  OXM analog
  MOD_RES (2)..(2): Xaa=1-Amino-1-cyclopentane carboxylic acid
  MOD_RES (37)..(37): C-terminal amidation

SEQ ID NO: 1846 - protein, 38 aa, Artificial Sequence
  OXM analog
  MOD_RES (2)..(2): Xaa=D-serine
  MOD_RES (38)..(38): C-terminal amidation
HXQGTFTSDYSKYLDSEAAQDFVQWLMNTKRNRNNIAC

SEQ ID NO: 1847 - protein, 31 aa, Artificial Sequence
  OXM analog
  MOD_RES (2)..(2): Xaa=D-serine
  MOD_RES (31)..(31): C-terminal amidation
HXQGTFTSDYSKYLDSRRAQDFVQWLMNTKC

SEQ ID NO: 1848 - protein, 31 aa, Artificial Sequence
  OXM analog
  MOD_RES (2)..(2): Xaa=D-serine
  MOD_RES (31)..(31): C-terminal amidation
HXQGTFTSDYSKYLDSEAAQDFVQWLMNTKC

SEQ ID NO: 1849 - protein, 31 aa, Artificial Sequence
  OXM analog
  MOD_RES (2)..(2): Xaa=D-serine
  MOD_RES (31)..(31): C-terminal amidation
HXQGTFTSDYSKYLDSERAQDFVQWLMNTKC

SEQ ID NO: 1850 - protein, 31 aa, Artificial Sequence
  OXM analog
  MOD_RES (2)..(2): Xaa=D-serine
  MOD_RES (31)..(31): C-terminal amidation
HXQGTFTSDYSKYLDSRAAQDFVQWLMNTKC

SEQ ID NO: 1851 - protein, 38 aa, Artificial Sequence
  OXM analog
  MOD_RES (2)..(2): Xaa=D-serine
  MOD_RES (38)..(38): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (38)..(38): C-terminal amidation
HXQGTFTSDYSKYLDSEAAQDFVQWLMNTKRNRNNIAX

SEQ ID NO: 1852 - protein, 31 aa, Artificial Sequence
  OXM analog
  MOD_RES (2)..(2): Xaa=D-serine
  MOD_RES (31)..(31): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (31)..(31): C-terminal amidation
HXQGTFTSDYSKYLDSRRAQDFVQWLMNTKX

SEQ ID NO: 1853 - protein, 31 aa, Artificial Sequence
  OXM analog
  MOD_RES (2)..(2): X=D-serine
  MOD_RES (31)..(31): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (31)..(31): C-terminal amidation
HXQGTFTSDYSKYLDSEAAQDFVQWLMNTKX

SEQ ID NO: 1854 - protein, 31 aa, Artificial Sequence
  OXM analog
  MOD_RES (2)..(2): Xaa=D-serine
  MOD_RES (31)..(31): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (31)..(31): C-terminal amidation
HXQGTFTSDYSKYLDSERAQDFVQWLMNTKX

SEQ ID NO: 1855 - protein, 31 aa, Artificial Sequence
  OXM analog
  MOD_RES (2)..(2): Xaa=D-serine
  MOD_RES (31)..(31): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (31)..(31): C-terminal amidation
HXQGTFTSDYSKYLDSRAAQDFVQWLMNTKX

SEQ ID NO: 1856 - protein, 31 aa, Artificial Sequence; identical to SEQ ID NO: 1852
  OXM analog
  MOD_RES (2)..(2): Xaa=D-serine
  MOD_RES (31)..(31): Xaa=Lys(Palmitoyl)
  MOD_RES (31)..(31): C-terminal amidation

SEQ ID NO: 1857 - protein, 31 aa, Artificial Sequence; identical to SEQ ID NO: 1853
  OXM analog
  MOD_RES (2)..(2): Xaa=D-serine
  MOD_RES (31)..(31): Xaa=Lys(palmitoyl)
  MOD_RES (31)..(31): C-terminal amidation

SEQ ID NO: 1858 - protein, 32 aa, Artificial Sequence
  OXM analog
  MOD_RES (2)..(2): Xaa=D-serine
  MOD_RES (31)..(31): Xaa=Ttds
  MOD_RES (32)..(32): Xaa=Lys(Palmitoyl)
  MOD_RES (32)..(32): C-terminal amidation
HXQGTFTSDYSKYLDSRRAQDFVQWLMNTKXX

SEQ ID NO: 1859 - protein, 32 aa, Artificial Sequence
  OXM analog
  MOD_RES (2)..(2): Xaa=D-serine
  MOD_RES (31)..(31): Xaa=Ttds
  MOD_RES (32)..(32): Xaa=Lys(Palmitoyl)
  MOD_RES (32)..(32): C-terminal amidation
HXQGTFTSDYSKYLDSEAAQDFVQWLMNTKXX

SEQ ID NO: 1860 - protein, 32 aa, Artificial Sequence; identical to SEQ ID NO: 1858
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl{[(2R)-3-amino-2-(amino)- 3-oxopropyl]thio}acetate)
  MOD_RES (32)..(32): C-terminal amidation

SEQ ID NO: 1861 - protein, 32 aa, Artificial Sequence; identical to SEQ ID NO: 1859
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl{[(2R)-3-amino-2-(amino)- 3-oxopropyl]thio}acetate)
  MOD_RES (32)..(32): C-terminal amidation

SEQ ID NO: 1862 - protein, 31 aa, Artificial Sequence; identical to SEQ ID NO: 1853
  OXM analog
  MOD_RES (2)..(2): Xaa=Aib
  MOD_RES (31)..(31): Xaa= Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (31)..(31): C-terminal amidation

SEQ ID NO: 1863 - protein, 39 aa, Artificial Sequence
  OXM analog
  MOD_RES (2)..(2): Xaa=D-serine
  MOD_RES (38)..(38): Xaa=gamma glutamic acid
  MOD_RES (39)..(39): Xaa=Cys(cholest-5-en-3-yl{[(2R)-3-amino-2-(amino)- 3-oxopropyl]thio}acetate)
  MOD_RES (39)..(39): C-terminal amidation
HXQGTFTSDYSKYLDSEAAQDFVQWLMNTKRNRNNIAXX

SEQ ID NO: 1864 - protein, 32 aa, Artificial Sequence
  OXM analog
  MOD_RES (2)..(2): Xaa=D-serine
  MOD_RES (32)..(32): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (32)..(32): C-terminal amidation
HXQGTFTSDYSKYLDSEAAQDFVQWLMNTKRX

SEQ ID NO: 1865 - protein, 38 aa, Artificial Sequence; identical to SEQ ID NO: 1851
  OXM analog
  MOD_RES (2)..(2): Xaa=D-serine
  MOD_RES (38)..(38): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))

SEQ ID NO: 1866 - protein, 31 aa, Artificial Sequence; identical to SEQ ID NO: 1854
  OXM analog
  MOD_RES (2)..(2): Xaa=Aib
  MOD_RES (31)..(31): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol))
  MOD_RES (31)..(31): C-terminal amidation

SEQ ID NO: 1867 - protein, 32 aa, Artificial Sequence; identical to SEQ ID NO: 1858
  OXM analog
  MOD_RES (2)..(2): Xaa=Aib
  MOD_RES (31)..(31): Xaa=gamma glutamic acid
  MOD_RES (32)..(32): Xaa=Cys(cholest-5-en-3-yl{[(2R)-3-amino-2-(amino)- 3-oxopropyl]thio}acetate)

SEQ ID NO: 1868 - protein, 39 aa, Artificial Sequence; identical to SEQ ID NO: 1863
  OXM analog
  MOD_RES (2)..(2): Xaa=D-serine
  MOD_RES (38)..(38): Xaa=gamma glutamic acid
  MOD_RES (39)..(39): Xaa=Lys(Palmitoyl)
  MOD_RES (39)..(39): C-terminal amidation

SEQ ID NO: 1869 - protein, 33 aa, Artificial Sequence
  OXM analog
  MOD_RES (2)..(2): Xaa=D-serine
  MOD_RES (31)..(32): Xaa=gamma glutamic acid
  MOD_RES (33)..(33): Xaa=Cys(cholest-5-en-3-yl{[(2R)-3-amino-2-(amino)- 3-oxopropyl]thio}acetate)
HXQGTFTSDYSKYLDSRRAQDFVQWLMNTKXXX

SEQ ID NO: 1870 - protein, 32 aa, Artificial Sequence
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl 1{[(2R)-3-amino-2-(amino)-3-oxopropyl]thio}acetate )
HXQGTFTSDYSSYLDSRRAQDFVQWLMNTKXX

SEQ ID NO: 1871 - protein, 32 aa, Artificial Sequence
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl 1{[(2R)-3-amino-2-(amino)-3-oxopropyl]thio}acetate );
HXQGTFTSDYSKYLDSRAAQDFVQWLMNTKXX

SEQ ID NO: 1872 - protein, 32 aa, Artificial Sequence; identical to SEQ ID NO: 1870
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol)

SEQ ID NO: 1873 - protein, 32 aa, Artificial Sequence; identical to SEQ ID NO: 1871
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol)

SEQ ID NO: 1874 - protein, 32 aa, Artificial Sequence
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl 1{[(2R)-3-amino-2-(amino)-3-oxopropyl]thio}acetate )
HXQGTFTSDYSKYLDERRAQDFVQWLMNTKXX

SEQ ID NO: 1875 - protein, 32 aa, Artificial Sequence; identical to SEQ ID NO: 1874
  OXM analog
  MOD_RES (2)..(2): Xaa=D-serine
  MOD_RES (31)..(31): Xaa=gamma glutamic acid
  MOD_RES (32)..(32): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol)

SEQ ID NO: 1876 - protein, 33 aa, Artificial Sequence; identical to SEQ ID NO: 1869
  OXM analog
  MOD_RES (2)..(2): Xaa=D-serine
  MOD_RES (31)..(32): Xaa=gamma glutamic acid
  MOD_RES (33)..(33): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol)

SEQ ID NO: 1877 - protein, 33 aa, Artificial Sequence; identical to SEQ ID NO: 1869
  OXM analog
  MOD_RES (2)..(2): Xaa=D-serine
  MOD_RES (31)..(32): Xaa=gamma glutamic acid
  MOD_RES (33)..(33): Xaa=S-{1-[46-(cholest-5-en-3-yloxy)-3,43,46-trioxo -7,10,13,16,19,22,25,28,31,34,37,40-dodecaoxa-4,44 -diazahexatetracont-1-yl]-2,5-dioxopyrrolidin-3-yl }-L-cysteine or Cys (mal-oxa12-cholesterol)

SEQ ID NO: 1878 - protein, 33 aa, Artificial Sequence; identical to SEQ ID NO: 1869
  OXM analog
  MOD_RES (2)..(2): Xaa=Aib
  MOD_RES (31)..(32): Xaa=gamma glutamic acid
  MOD_RES (33)..(33): Xaa== Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol)

SEQ ID NO: 1879 - protein, 33 aa, Artificial Sequence; identical to SEQ ID NO: 1869
  OXM analog
  MOD_RES (2)..(2): Xaa=1-Amino-1-cyclobutane carboxylic acid
  MOD_RES (31)..(32): Xaa=gamma glutamic acid
  MOD_RES (33)..(33): Xaa=Cys(cholest-5-en-3-yl 1-{[(2R)-3-amino-2-(amino)-3-oxopropyl]thio}-2-oxo -6,9,12,15-tetraoxa-3-azaoctadecan-18-oate]) or Cys(Oxa4-cholesterol)

SEQ ID NO: 1880 - protein, 33 aa, Artificial Sequence
  OXM analog
  MOD_RES (2)..(2): Xaa=D-serine
  MISC_FEATURE (16)..(20): Lactam bridge between side chains
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)
HXQGTFTSDYSKYLDERRAKDFVQWLMNTKXXX

SEQ ID NO: 1881 - protein, 33 aa, Artificial Sequence; identical to SEQ ID NO: 1880
  OXM analog
  MOD_RES (2)..(2): Xaa=Aib
  MISC_FEATURE (16)..(20): Lactam bridge between side chains
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)

SEQ ID NO: 1882 - protein, 33 aa, Artificial Sequence; identical to SEQ ID NO: 1880
  OXM analog
  MOD_RES (2)..(2): Xaa=1-Amino-1-cyclobutane carboxylic acid
  MISC_FEATURE (16)..(20): Lactam bridge between side chains
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)

SEQ ID NO: 1883 - protein, 33 aa, Artificial Sequence; identical to SEQ ID NO: 1869
  OXM analog
  MOD_RES (2)..(2): Xaa=D-serine
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)

SEQ ID NO: 1884 - protein, 33 aa, Artificial Sequence; identical to SEQ ID NO: 1869
  OXM analog
  MOD_RES (2)..(2): Xaa=Aib
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)

SEQ ID NO: 1885 - protein, 33 aa, Artificial Sequence; identical to SEQ ID NO: 1869
  OXM analog
  MOD_RES (2)..(2): Xaa=1-Amino-1-cyclobutane carboxylic acid
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)

SEQ ID NO: 1886 - protein, 33 aa, Artificial Sequence; identical to SEQ ID NO: 1869
  OXM analog
  MOD_RES (2)..(2): Xaa=D-serine
  MOD_RES (31)..(32): Xaa=gamma glutamic acid
  MOD_RES (33)..(33): Xaa=Lys(gamma-glutamic acid-palmitoyl)
  MOD_RES (33)..(33): C-terminal amidation

SEQ ID NO: 1887 - protein, 33 aa, Artificial Sequence
  OXM analog
  MOD_RES (2)..(2): Xaa=D-serine
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)
  MOD_RES (33)..(33): C-terminal amidation
HXQGTFTSDYSKYLDERRAQDFVQWLMNTKXXX

SEQ ID NO: 1888 - protein, 32 aa, Artificial Sequence
  OXM analog
  MOD_RES (2)..(2): Xaa=D-serine
  MOD_RES (20)..(20): Xaa=Lys(gamma-glutamic acid-palmitoyl)
  MOD_RES (31)..(32): Xaa=gamma glutamic acid
  MOD_RES (32)..(32): C-terminal amidation
HXQGTFTSDYSKYLDSRRAXDFVQWLMNTKXX

SEQ ID NO: 1889 - protein, 31 aa, Artificial Sequence
  OXM analog
  MOD_RES (2)..(2): Xaa=D-serine
  MOD_RES (20)..(20): Xaa=Lys(gamma-glutamic acid-gamma-glutamic acid-palmitoyl)
  MOD_RES (31)..(31): Xaa=gamma glutamic acid
  MOD_RES (31)..(31): C-terminal amidation
HXQGTFTSDYSKYLDSRRAXDFVQWLMNTKX

SEQ ID NO: 1890 - protein, 30 aa, Artificial Sequence
  OXM analog
  MOD_RES (2)..(2): Xaa=D-serine
  MOD_RES (10)..(10): Xaa=Lys(gamma-glutamic acid-gamma-glutamic acid-palmitoyl)
  MOD_RES (30)..(30): C-terminal amidation
HXQGTFTSDXSKYLDSRRAQDFVQWLMNTK

SEQ ID NO: 1891 - protein, 30 aa, Artificial Sequence
  OXM analog
  MOD_RES (2)..(2): Xaa=D-serine
  MOD_RES (20)..(20): Xaa=Lys(gamma-glutamic acid-gamma-glutamic acid-palmitoyl)
  MOD_RES (30)..(30): C-terminal amidation
HXQGTFTSDYSKYLDERRAXDFVQWLMNTK

SEQ ID NO: 1892 - protein, 30 aa, Artificial Sequence
  OXM analog
  MOD_RES (2)..(2): Xaa=D-serine
  MOD_RES (10)..(10): Xaa=Lys(gamma-glutamic acid-gamma-glutamic acid-palmitoyl)
  MOD_RES (30)..(30): C-terminal amidation
HXQGTFTSDXSKYLDERRAQDFVQWLMNTK

SEQ ID NO: 1893 - protein, 33 aa, Artificial Sequence; identical to SEQ ID NO: 1869
  OXM analog
  MOD_RES (2)..(2): Xaa=D-serine
  MOD_RES (31)..(32): Xaa=gamma glutamic acid
  MOD_RES (33)..(33): Xaa=S-[78-(cholest-5-en-3-yloxy)-2,78-dioxo-6,9,12 ,15,18,21,24,27,30,33,36,39,42,45,48,51,54,57,60,6 3,66,69,72,75-tetracosaoxa-3-azaoctaheptacont-1-yl ]-L-cysteine or Cys (oxa24-cholesterol)

SEQ ID NO: 1894 - protein, 33 aa, Artificial Sequence
  OXM analog
  MOD_RES (2)..(2): Xaa=Aib
  MOD_RES (24)..(24): Xaa=Lys(DOTA)
  MOD_RES (27)..(27): Xaa=methionine sulfoxide
  MOD_RES (31)..(32): Xaa=gamma glutamic acid
  MOD_RES (33)..(33): Xaa=S-[42-(cholest-5-en-3-yloxy)-2,42-dioxo-6,9,12 ,15,18,21,24,27,30,33,36,39-dodecaoxa-3-azadotetra cont-1-yl]-L-cysteine or Cys (oxa12-cholesterol)
  MOD_RES (33)..(33): C-terminal amidation
HXDGTFTSDYSKYLDSRRAQDFVXWLXNTKXXX

SEQ ID NO: 1895 - protein, 31 aa, Artificial Sequence
  OXM analog
  MOD_RES (2)..(2): Xaa=D-serine
  MOD_RES (10)..(10): Xaa=Lys(gamma glutamic acid-palmitoyl)
  MOD_RES (31)..(31): Xaa=gamma glutamic acid
  MOD_RES (31)..(31): C-terminal amidation
HXQGTFTSDXSKYLDERRAQDFVQWLMNTKX

SEQ ID NO: 1896 - protein, 32 aa, Artificial Sequence
  OXM analog
  MOD_RES (2)..(2): Xaa=D-serine
  MOD_RES (10)..(10): Xaa=Lys(palmitoyl)
  MOD_RES (31)..(32): Xaa=gamma glutamic acid
  MOD_RES (32)..(32): C-terminal amidation
HXQGTFTSDXSKYLDERRAQDFVQWLMNTKXX

SEQ ID NO: 1897 - protein, 30 aa, Artificial Sequence; identical to SEQ ID NO: 1892
  OXM analog
  MOD_RES (2)..(2): Xaa=aib
  MOD_RES (10)..(10): Xaa=Lys(gamma-glutamic acid-gamma glutamic acid-palmitoyl)
  MOD_RES (30)..(30): C-terminal amidation

SEQ ID NO: 1898 - protein, 30 aa, Artificial Sequence; identical to SEQ ID NO: 1892
  OXM analog
  MOD_RES (2)..(2): Xaa=acb
  MOD_RES (10)..(10): Xaa=Lys(gamma-glutamic acid-gamma-glutamic acid-palmitoyl
  MOD_RES (30)..(30): C-terminal amidation

SEQ ID NO: 1899 - protein, 31 aa, Artificial Sequence; identical to SEQ ID NO: 1895
  OXM analog
  MOD_RES (2)..(2): Xaa=D-Serine
  MOD_RES (10)..(10): Xaa=Lys(gamma-glutamic acid-gamma-glutamic acid-palmitoyl
  MOD_RES (16)..(16): Xaa=aib
  MOD_RES (31)..(31): Xaa=gamma glutamic acid
  MOD_RES (31)..(31): C-terminal amidation

SEQ ID NO: 1900 - protein, 33 aa, Artificial Sequence; identical to SEQ ID NO: 1869
  OXM analog
  MOD_RES (2)..(2): Xaa=aib
  MOD_RES (31)..(32): Xaa=gamma glutamic acid
  MOD_RES (33)..(33): Xaa=Lys(gamma glutamic acid-palmitoyl)
  MOD_RES (33)..(33): C-terminal amidation

SEQ ID NO: 1901 - protein, 33 aa, Artificial Sequence; identical to SEQ ID NO: 1869
  OXM analog
  MOD_RES (2)..(2): Xaa=acb
  MOD_RES (31)..(32): Xaa=gamma glutamic acid
  MOD_RES (33)..(33): Xaa=Lys(gamma glutamic acid-palmitoyl)
  MOD_RES (33)..(33): C-terminal amidation

SEQ ID NO: 1902 - protein, 33 aa, Artificial Sequence; identical to SEQ ID NO: 1869
  OXM analog
  MOD_RES (2)..(2): Xaa=D-serine
  MOD_RES (31)..(32): Xaa=gamma glutamic acid
  MOD_RES (33)..(33): Xaa=S-[38-(cholest-5-en-3-yloxy)-2-oxo-6,9,12,15,1 8,21,24,27,30,33,36-undecaoxa-3-azaoctatriacont-1- yl]-L-cysteine or Cys (oxa12-O-cholesterol)

SEQ ID NO: 1903 - protein, 30 aa, Artificial Sequence
  OXM analog
  VARIANT (2)..(2): Xaa=D-serine or Aib;
  VARIANT (17)..(17): Xaa=Arg or Glu
  VARIANT (18)..(18): Xaa=Arg or Ala
  VARIANT (27)..(27): Xaa=methionine, norleucine, or O-methyl-L-homoserine
HXQGTFTSDYSKYLDSXXAQDFVQWLXNTK

SEQ ID NO: 1904 - protein, 7 aa, Artificial Sequence
  OXM peptide
RNRNNIA

SEQ ID NO: 1905 - protein, 37 aa, Artificial Sequence
  OXM analog
  VARIANT (2)..(2): Xaa=D-serine; Aib; Acb; 1-Amino-1-cyclohexane carboxylic acid (Acx); alpha-aminobutyric acid(Abu); D- alpha-aminobutyric acid (D-Abu); Aminovaleric acid Nva); beta-cyclopropyl-alanine (Cpa); propargylglycine (Prg); Allylglycine (Alg);
  VARIANT (17)..(17): Xaa=Arg or Glu
  VARIANT (18)..(18): Xaa=Arg or Ala
  VARIANT (27)..(27): Xaa=methionine (M), norleucine (Nle), methionine sulfoxide (m) or O-methyl-L-homoserine (o)
HXQGTFTSDYSKYLDSXXAQDFVQWLXNTKRNRNNIA

SEQ ID NO: 1906 - protein, 37 aa, Artificial Sequence
  OXM analog
  VARIANT (2)..(2): Xaa = D-Ser,  Aib,  Acb, Acx,  Abu, D-Abu, Aminovaleric acid (Nva), Cpa, Prg, Alg, 2-Cha, D-tbg, Vg, Acp, or Acpe
  VARIANT (12)..(12): Xaa=Ser or Lys
  VARIANT (16)..(16): Xaa=Ser or Glu
  VARIANT (17)..(17): Xaa=Arg or Glu
  VARIANT (18)..(18): Xaa=Arg or Ala
  VARIANT (20)..(20): Xaa=Gln or Lys
  VARIANT (27)..(27): Xaa=a methionine, norleucine, methionine sulfoxide, or O-methyl-L-homoserine
HXQGTFTSDYSXYLDXXXAXDFVQWLXNTKRNRNNIA

SEQ ID NO: 1907 - protein, 31 aa, Artificial Sequence
  OXM analog
  VARIANT (2)..(2): Xaa = D-Ser,  Aib,  Acb, Acx,  Abu, D-Abu, Aminovaleric acid (Nva), Cpa, Prg, Alg, 2-Cha, D-tbg, Vg, Acp, or Acpe
  VARIANT (10)..(10): Xaa=Tyr or Lys
  VARIANT (12)..(12): Xaa=Ser or Lys
  VARIANT (16)..(16): Xaa=Ser or Glu
  VARIANT (17)..(17): Xaa=Arg or Glu
  VARIANT (18)..(18): Xaa=Arg or Ala
  VARIANT (20)..(20): Xaa=Gln or Lys
  VARIANT (27)..(27): Xaa=methionine, norleucine, methionine sulfoxide, or O-methyl-L-homoserine
  VARIANT (31)..(31): Xaa=optional, but when present is one or more gamma glutamic acid residues
HXQGTFTSDXSXYLDXXXAXDFVQWLXNTKX

SEQ ID NO: 1908 - protein, 31 aa, Artificial Sequence; identical to SEQ ID NO: 1907
  OXM analog
  MOD_RES (2)..(2): Xaa = D-Ser,  Aib,  Acb, Acx,  Abu, D-Abu, Aminovaleric acid (Nva), Cpa, Prg, Alg, 2-Cha, D-tbg, Vg, Acp, or Acpe
  MOD_RES (10)..(10): Xaa=Tyr or Lys
  MOD_RES (12)..(12): Xaa=Ser or Lys
  MOD_RES (16)..(16): Xaa=Ser or Lys
  MOD_RES (17)..(17): Xaa=Arg or Glu
  MOD_RES (18)..(18): Xaa=Arg or Ala
  MOD_RES (20)..(20): Xaa=Gln or Lys
  MOD_RES (27)..(27): Xaa=methionine, norleucine, methionine sulfoxide, or O-methyl-L-homoserine
  MOD_RES (31)..(31): optional, but when present one or more gamma glutamic acid residues

SEQ ID NO: 1909 - protein, 30 aa, Artificial Sequence
  OXM analog
HSQGTFTSDSSKYLDSRRAQDFVQWLMNTK

SEQ ID NO: 1910 - protein, 32 aa, Artificial Sequence
  OXM analog
  MOD_RES (2)..(2): Xaa=D-serine, Aib, Acb, Acx, Abu, D-Abu,  Aminovaleric acid (Nva), Cpa, Prg, Alg, 2-Cha, D-tbg, Vg, Acp, or Acpe
  MOD_RES (10)..(10): Xaa=Tyr or Lys
  MOD_RES (12)..(12): Xaa=Ser or Lys
  MOD_RES (16)..(16): Xaa=Ser, aib,  or Glu
  MOD_RES (17)..(17): Xaa=Arg or Glu
  MOD_RES (18)..(18): Xaa=Arg or Ala
  MOD_RES (20)..(20): Xaa=Glu or Lys
  MOD_RES (27)..(27): Xaa=Met, norleucine, methionine sulfoxide, or O-methyl-L-homoserine
  MOD_RES (31)..(31): Xaa=gamma-glutamic acid
  MOD_RES (32)..(32): Xaa=is optional but when present, it is gamma-glutamic acid
HXQGTFTSDXSXYLDXXXAXDFVQWLXNTKXX

SEQ ID NO: 1911 - protein, 31 aa, Artificial Sequence
  OXM analog
  MOD_RES (2)..(2): Xaa=D-serine
  MOD_RES (10)..(10): Xaa=Lys(gamma-glutamic acid-gamma-glutamic acid-palmitoyl)
  MOD_RES (16)..(16): Xaa=Aib
  MOD_RES (31)..(31): Xaa=gamma-glutamic acid
  MOD_RES (31)..(31): C-terminal amidation
HXQGTFTSDXSKYLDXRRAQDFVQWLMNTEX

SEQ ID NO: 1912 - protein, 31 aa, Artificial Sequence
  OXM analog
  MOD_RES (2)..(2): Xaa=D-serine
  MOD_RES (10)..(10): Xaa=Lys(gamma-glutamic acid-gamma-glutamic acid-palmitoyl)
  MOD_RES (16)..(16): Xaa=aib
  MOD_RES (30)..(30): Xaa=D-Lys
  MOD_RES (31)..(31): Xaa=gamma-glutamic acid
  MOD_RES (31)..(31): C-terminal amidation
HXQGTFTSDXSKYLDXRRAQDFVQWLMNTXX

SEQ ID NO: 1913 - protein, 31 aa, Artificial Sequence; identical to SEQ ID NO: 1895
  OXM analog
  MOD_RES (2)..(2): Xaa=D-serine
  MOD_RES (10)..(10): Xaa=Lys(gamma-glutamic acid-gamma-glutamic acid-palmitoyl)
  MOD_RES (31)..(31): Xaa=gamma-glutamic acid
  MOD_RES (31)..(31): C-terminal amidation

SEQ ID NO: 1914 - protein, 31 aa, Artificial Sequence; identical to SEQ ID NO: 1911
  OXM analog
  MOD_RES (2)..(2): Xaa=D-serine
  MOD_RES (10)..(10): Xaa=Lys(gamma-glutamic acid-gamma-glutamic acid-palmitoyl)
  MOD_RES (16)..(16): Xaa=aib
  MOD_RES (31)..(31): Xaa=gamma-D-glutamic acid

SEQ ID NO: 1915 - protein, 31 aa, Artificial Sequence; identical to SEQ ID NO: 1895
  OXM analog
  MOD_RES (2)..(2): Xaa=D-serine
  MOD_RES (10)..(10): Xaa=Lys(glutamic acid-glutamic acid-palmitoyl)
  MOD_RES (31)..(31): Xaa=gamma-glutamic acid
  MOD_RES (31)..(31): C-terminal amidation

SEQ ID NO: 1916 - protein, 31 aa, Artificial Sequence; identical to SEQ ID NO: 1895
  OXM analog
  MOD_RES (2)..(2): Xaa=D-serine
  MOD_RES (10)..(10): Xaa=Lys(Arg-Arg-palmitoyl)
  MOD_RES (31)..(31): Xaa=gamma-glutamic acid
  MOD_RES (31)..(31): C-terminal amidation

SEQ ID NO: 1917 - protein, 31 aa, Artificial Sequence; identical to SEQ ID NO: 1895
  OXM analog
  MOD_RES (2)..(2): Xaa=D-Serine
  MOD_RES (10)..(10): Xaa=Lys(homocysteic acid-homocysteic acid-palmitoyl)
  MOD_RES (31)..(31): Xaa=gamma-glutamic acid
  MOD_RES (31)..(31): C-terminal amidation

SEQ ID NO: 1918 - protein, 31 aa, Artificial Sequence; identical to SEQ ID NO: 1895
  OXM analog
  MOD_RES (2)..(2): Xaa=D-Serine
  MOD_RES (10)..(10): Xaa=Lys(D-glutamic acid-D-glutamic acid-palmitoyl)
  MOD_RES (31)..(31): Xaa=gamma-glutamic acid
  MOD_RES (31)..(31): C-terminal amidation

SEQ ID NO: 1919 - protein, 31 aa, Artificial Sequence
  OXM analog
  MOD_RES (2)..(2): Xaa=D-Serine
  MOD_RES (10)..(10): Xaa=Lys(gamma-glutamic acid-gamma-glutamic acid-myristoyl)
  MOD_RES (16)..(16): Xaa=aib
  MOD_RES (31)..(31): Xaa=gamma-glutamic acid
  MOD_RES (31)..(31): C-terminal amidation
HXQGTFTSDXSKYLDXRRAQDFVQWLMNTKX

SEQ ID NO: 1920 - protein, 31 aa, Artificial Sequence
  OXM analog
  MOD_RES (2)..(2): Xaa=D-Serine
  MOD_RES (10)..(10): Xaa=Lys(gamma-glutamic acid-gamma-glutamic acid-palmitoyl)
  MOD_RES (16)..(16): Xaa=aib
  MOD_RES (31)..(31): Xaa=gamma-glutamic acid
  MOD_RES (31)..(31): C-terminal amidation
HXQGTFTSDXSKYLDXRAAQDFVQWLMDTKX

SEQ ID NO: 1921 - protein, 31 aa, Artificial Sequence; identical to SEQ ID NO: 1919
  OXM analog
  MOD_RES (2)..(2): Xaa=D-Serine
  MOD_RES (10)..(10): Xaa=Lys(gamma-glutamic acid-gamma-glutamic acid-stearoyl)
  MOD_RES (16)..(16): Xaa=aib
  MOD_RES (31)..(31): Xaa=gamma-glutamic acid
  MOD_RES (31)..(31): C-terminal amidation

What is claimed:
1. A prodrug comprising the structure:

A-B-Q;

wherein Q is a glucagon superfamily peptide;
wherein A-B comprises the structure:

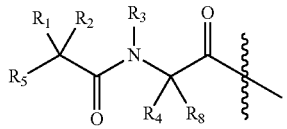

wherein
(I) $R_1$ and $R_2$ are independently selected from the group consisting of H, $C_1$-$C_{18}$ alkyl, $C_2$-$C_{18}$ alkenyl, ($C_1$-$C_{18}$ alkyl)OH, ($C_1$-$C_{18}$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2^+$)NH$_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl)$R_7$, ($C_1$-$C_4$ alkyl)($C_3$-$C_9$ heteroaryl), and $C_1$-$C_{12}$ alkyl($W_1$)$C_1$-$C_{12}$ alkyl, wherein $W_1$ is a heteroatom selected from the group consisting of N, S and O, or $R_1$ and $R_2$ together with the atoms to which they are attached form a $C_3$-$C_{12}$ cycloalkyl;
$R_3$ is $C_1$-$C_{18}$ alkyl;
$R_4$ and $R_8$ are each H;
$R_5$ is NHR$_6$, or $R_5$ and $R_2$ together with the atoms to which they are attached form a 4, 5 or 6 member heterocyclic ring;
$R_6$ is H or $C_1$-$C_4$ alkyl; and,
$R_7$ is selected from the group consisting of H, OH, halo, ($C_1$-$C_7$ alkyl), ($C_2$-$C_7$ alkenyl), OCF$_3$, NO$_2$, CN, NC, O($C_1$-$C_7$ alkyl), CO$_2$H, CO$_2$($C_1$-$C_7$ alkyl), NHR$_6$, aryl, and heteroaryl;
wherein A-B is linked to Q through an amide bond between A-B and an aliphatic amino group of Q;
wherein chemical cleavage half-life ($t_{1/2}$) of A-B from Q is at least about 1 hour to about 1 week in PBS under physiological conditions;
with the proviso that A-B is not Gly-(N-methyl-Gly);
(II) $R_1$ and $R_2$ are independently selected from the group consisting of H, $C_1$-$C_{18}$ alkyl, $C_2$-$C_{18}$ alkenyl, ($C_1$-$C_{18}$ alkyl)OH, ($C_1$-$C_{18}$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2^+$)NH$_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl)$R_7$, ($C_1$-$C_4$ alkyl)($C_3$-$C_9$ heteroaryl), and $C_1$-$C_{12}$ alkyl($W_1$)$C_1$-$C_{12}$ alkyl, wherein $W_1$ is a heteroatom selected from the group consisting of N, S and O, or $R_1$ and $R_2$ together with the atoms to which they are attached form a $C_3$-$C_{12}$ cycloalkyl;
$R_3$ is $C_1$-$C_{18}$ alkyl;
$R_4$ is selected from the group consisting of CH$_3$, CH$_2$($C_1$-$C_{10}$ alkyl), CH$_2$($C_2$-$C_{10}$ alkenyl), CH$_2$($C_0$-$C_{10}$ alkyl)OH, CH$_2$($C_0$-$C_{10}$ alkyl)SH, CH$_2$($C_0$-$C_3$ alkyl)SCH$_3$, CH$_2$($C_0$-$C_3$ alkyl)CONH$_2$, CH$_2$($C_0$-$C_3$ alkyl)COOH, CH$_2$($C_0$-$C_3$ alkyl)NH$_2$, CH$_2$($C_0$-$C_3$ alkyl)NHC(NH$_2^+$)NH$_2$, CH$_2$($C_0$-$C_3$ alkyl)($C_3$-$C_6$ cycloalkyl), CH$_2$($C_0$-$C_3$ alkyl)($C_2$-$C_5$ heterocyclic), CH$_2$($C_0$-$C_3$ alkyl)($C_6$-$C_{10}$ aryl)$R_7$, CH$_2$($C_1$-$C_3$ alkyl)($C_3$-$C_9$ heteroaryl), and CH$_2$($C_0$-$C_{12}$ alkyl)($W_1$)$C_1$-$C_{12}$ alkyl, wherein $W_1$ is a heteroatom selected from the group consisting of N, S and O, or $R_4$ and $R_3$ together with the atoms to which they are attached form a pyrrolidine ring;
$R_8$ is H;
$R_5$ is NHR$_6$, or $R_5$ and $R_2$ together with the atoms to which they are attached form a 4, 5 or 6 member heterocyclic ring;
$R_6$ is H or $C_1$-$C_4$ alkyl; and,
$R_7$ is selected from the group consisting of H, OH, halo, ($C_1$-$C_7$ alkyl), ($C_2$-$C_7$ alkenyl), OCF$_3$, NO$_2$, CN, NC, O($C_1$-$C_7$ alkyl), CO$_2$H, CO$_2$($C_1$-$C_7$ alkyl), NHR$_6$, aryl, and heteroaryl;
wherein A-B is linked to Q through an amide bond between A-B and an aliphatic amino group of Q;
wherein chemical cleavage half-life ($t_{1/2}$) of A-B from Q is at least about 1 hour to about 1 week in PBS under physiological conditions;
(III) $R_1$ and $R_2$ are independently selected from the group consisting of H, $C_1$-$C_{18}$ alkyl, $C_2$-$C_{18}$ alkenyl, ($C_1$-$C_{18}$ alkyl)OH, ($C_1$-$C_{18}$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2^+$)NH$_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl)$R_7$, ($C_1$-$C_4$ alkyl)($C_3$-$C_9$ heteroaryl), and $C_1$-$C_{12}$ alkyl($W_1$)$C_1$-$C_{12}$ alkyl, wherein $W_1$ is a heteroatom selected from the group consisting of N, S and O, or $R_1$ and $R_2$ together with the atoms to which they are attached form a $C_3$-$C_{12}$ cycloalkyl; or $R_1$ and $R_2$ together with the atoms to which they are attached form a $C_3$-$C_{12}$ cycloalkyl;
$R_3$ is $C_1$-$C_{18}$ alkyl;
$R_4$ is independently selected from the group consisting of CH($C_1$-$C_8$ alkyl)$_2$, CH($C_2$-$C_8$ alkenyl)$_2$, CH($C_1$-$C_8$ alkyl)(OH), CH($C_1$-$C_8$ alkyl)(($C_1$-$C_8$ alkyl)SH), and CH($C_1$-$C_3$ alkyl)(($C_1$-$C_8$ alkyl)(NH$_2$));
$R_8$ is H;
$R_5$ is NHR$_6$, or $R_5$ and $R_2$ together with the atoms to which they are attached form a 4, 5 or 6 member heterocyclic ring;
$R_6$ is H or $C_1$-$C_4$ alkyl; and,
$R_7$ is selected from the group consisting of H, OH, halo, ($C_1$-$C_7$ alkyl), ($C_2$-$C_7$ alkenyl), OCF$_3$, NO$_2$, CN, NC, O($C_1$-$C_7$ alkyl), CO$_2$H, CO$_2$($C_1$-$C_7$ alkyl), NHR$_6$, aryl, and heteroaryl;
wherein A-B is linked to Q through an amide bond between A-B and an aliphatic amino group of Q;
wherein chemical cleavage half-life ($t_{1/2}$) of A-B from Q is at least about 1 hour to about 1 week in PBS under physiological conditions;
(IV) $R_1$ and $R_2$ are independently selected from the group consisting of H, $C_1$-$C_{18}$ alkyl, $C_2$-$C_{18}$ alkenyl, ($C_1$-$C_{18}$ alkyl)OH, ($C_1$-$C_{18}$ alkyl)SH, ($C_2$-$C_3$ alkyl)SCH$_3$, ($C_1$-$C_4$ alkyl)CONH$_2$, ($C_1$-$C_4$ alkyl)COOH, ($C_1$-$C_4$ alkyl)NH$_2$, ($C_1$-$C_4$ alkyl)NHC(NH$_2^+$)NH$_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl)$R_7$, ($C_1$-$C_4$ alkyl)($C_3$-$C_9$ heteroaryl), and $C_1$-$C_{12}$ alkyl($W_1$)$C_1$-$C_{12}$ alkyl, wherein $W_1$ is a heteroatom selected from the group consisting of N, S and O, or $R_1$ and $R_2$ together with the atoms to which they are attached form a $C_3$-$C_{12}$ cycloalkyl;
$R_3$ is $C_1$-$C_{18}$ alkyl;
$R_4$ and $R_8$ are each H;
$R_5$ is NHR$_6$, or $R_5$ and $R_2$ together with the atoms to which they are attached form a 4, 5 or 6 member heterocyclic ring;
$R_6$ is H or $C_1$-$C_4$ alkyl; and,
$R_7$ is selected from the group consisting of H, OH, halo, ($C_1$-$C_7$ alkyl), ($C_2$-$C_7$ alkenyl), OCF$_3$, NO$_2$, CN, NC, O($C_1$-$C_7$ alkyl), CO$_2$H, CO$_2$($C_1$-$C_7$ alkyl), NHR$_6$, aryl, and heteroaryl;

wherein A-B is linked to Q through an amide bond between A-B and an aromatic amino group on an amino acid side chain of Q;

wherein chemical cleavage half-life ($t_{1/2}$) of A-B from Q is at least about 1 hour to about 1 week in PBS under physiological conditions;

(V) $R_1$ and $R_2$ are independently selected from the group consisting of H, $C_1$-$C_{18}$ alkyl, $C_2$-$C_{18}$ alkenyl, ($C_1$-$C_{18}$ alkyl)OH, ($C_1$-$C_{18}$ alkyl)SH, ($C_2$-$C_3$ alkyl)$SCH_3$, ($C_1$-$C_4$ alkyl)$CONH_2$, ($C_1$-$C_4$ alkyl)COOH, ($C_1$-$C_4$ alkyl)$NH_2$, ($C_1$-$C_4$ alkyl)NHC($NH_2^+$)$NH_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl)$R_7$, ($C_1$-$C_4$ alkyl)($C_3$-$C_9$ heteroaryl), and $C_1$-$C_{12}$ alkyl($W_1$)$C_1$-$C_{12}$ alkyl, wherein $W_1$ is a heteroatom selected from the group consisting of N, S and O, or $R_1$ and $R_2$ together with the atoms to which they are attached form a $C_3$-$C_{12}$ cycloalkyl; or $R_1$ and $R_2$ together with the atoms to which they are attached form a $C_3$-$C_{12}$ cycloalkyl;

$R_3$ is $C_1$-$C_{18}$ alkyl;

$R_4$ is independently selected from the group consisting of CH($C_1$-$C_8$ alkyl)$_2$, CH($C_2$-$C_8$ alkenyl)$_2$, CH($C_1$-$C_8$ alkyl)(OH), CH($C_1$-$C_8$ alkyl)(($C_1$-$C_8$ alkyl)SH), and CH($C_1$-$C_3$ alkyl)(($C_1$-$C_8$ alkyl) ($NH_2$));

$R_8$ is H;

$R_5$ is $NHR_6$, or $R_5$ and $R_2$ together with the atoms to which they are attached form a 4, 5 or 6 member heterocyclic ring;

$R_6$ is H or $C_1$-$C_4$ alkyl; and, $R_7$ is selected from the group consisting of H, OH, halo, ($C_1$-$C_7$ alkyl), ($C_2$-$C_7$ alkenyl), $OCF_3$, $NO_2$, CN, NC, O($C_1$-$C_7$ alkyl), $CO_2H$, $CO_2$($C_1$-$C_7$ alkyl), $NHR_6$, aryl, and heteroaryl;

wherein A-B is linked to Q through an amide bond between A-B and an aromatic amino group an amino acid side chain of Q;

wherein chemical cleavage half-life ($t_{1/2}$) of A-B from Q is at least about 1 hour to about 1 week in PBS under physiological conditions; or (VI) $R_1$ and $R_2$ are independently selected from the group consisting of H, $C_1$-$C_{18}$ alkyl, $C_2$-$C_{18}$ alkenyl, ($C_1$-$C_{18}$ alkyl)OH, ($C_1$-$C_{18}$ alkyl)SH, ($C_2$-$C_3$ alkyl)$SCH_3$, ($C_1$-$C_4$ alkyl)$CONH_2$, ($C_1$-$C_4$ alkyl)COOH, ($C_1$-$C_4$ alkyl)$NH_2$, ($C_1$-$C_4$ alkyl)NHC($NH_2^+$)$NH_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl)$R_7$, ($C_1$-$C_4$ alkyl)($C_3$-$C_9$ heteroaryl), and $C_{12}$ alkyl($W_1$)$C_1$-$C_{12}$ alkyl, wherein $W_1$ is a heteroatom selected from the group consisting of N, S and O, or $R_1$ and $R_2$ together with the atoms to which they are attached form a $C_3$-$C_{12}$ cycloalkyl; or $R_1$ and $R_2$ together with the atoms to which they are attached form a $C_3$-$C_{12}$ cycloalkyl;

$R_3$ is $C_1$-$C_{18}$ alkyl;

$R_4$ is independently selected from the group consisting of CH($C_1$-$C_8$ alkyl)$_2$, CH($C_2$-$C_8$ alkenyl)$_2$, CH($C_1$-$C_8$ alkyl)(OH), CH($C_1$-$C_8$ alkyl)(($C_1$-$C_8$ alkyl)SH), and CH($C_1$-$C_3$ alkyl)(($C_1$-$C_8$ alkyl)($NH_2$);

$R_8$ is H;

$R_5$ is $NHR_6$, or $R_5$ and $R_2$ together with the atoms to which they are attached form a 4, 5 or 6 member heterocyclic ring;

$R_6$ is H or $C_1$-$C_4$ alkyl; and, $R_7$ is selected from the group consisting of H, OH, halo, ($C_1$-$C_7$ alkyl), ($C_2$-$C_7$ alkenyl), $OCF_3$, $NO_2$, CN, NC, O($C_1$-$C_7$ alkyl), $CO_2H$, $CO_2$($C_1$-$C_7$ alkyl), $NHR_6$, aryl, and heteroaryl;

wherein A-B is linked to Q through an amide bond between A-B and an aromatic amino group an an amino acid side chain of Q;

wherein chemical cleavage half-life ($t_{1/2}$) of A-B from Q is at least about 1 hour to about 1 week in PBS under physiological conditions.

2. The prodrug of claim 1, wherein for structure (I), B is selected from the group consisting of glycine(N-methyl), glycine(N-ethyl), glycine(N-propyl), glycine(N-butyl), glycine(N-pentyl), glycine(N-hexyl), glycine(N-heptyl), and glycine(N-octyl).

3. The prodrug of claim 1, wherein for structure (II), $R_4$ is selected from the group consisting of $CH_3$, $CH_2$($C_1$-$C_4$ alkyl), $CH_2$($C_1$-$C_4$) alkenyl, $CH_2$($C_0$-$C_4$ alkyl)OH, $CH_2$($C_0$-$C_4$ alkyl)SH, $CH_2$($C_0$-$C_3$ alkyl)$SCH_3$, $CH_2$($C_0$-$C_3$ alkyl)$CONH_2$, $CH_2$($C_0$-$C_3$ alkyl)COOH, $CH_2$($C_0$-$C_4$ alkyl)$NH_2$, and $CH_2$($C_0$-$C_3$ alkyl)NHC($NH_2^+$)$NH_2$.

4. The prodrug of claim 3, wherein B is selected from the group consisting of alanine(N—$C_1$-$C_{10}$alkyl), leucine(N—$C_1$-$C_{10}$alkyl), methionine(N—$C_1$-$C_{10}$alkyl), asparagine(N—$C_1$-$C_{10}$alkyl), glutamic acid(N—$C_1$-$C_{10}$alkyl), aspartic acid (N—$C_1$-$C_{10}$alkyl), glutamine(N—$C_1$-$C_{10}$alkyl), histidine (N—$C_1$-$C_{10}$alkyl), lysine(N—$C_1$-$C_{10}$alkyl), arginine(N—$C_1$-$C_{10}$alkyl), serine(N—$C_1$-$C_{10}$alkyl), cysteine(N—$C_1$-$C_{10}$alkyl), alanine(N—$C_1$-$C_6$alkyl), leucine(N—$C_1$-$C_6$alkyl), methionine(N—$C_1$-$C_6$alkyl), asparagine(N—$C_1$-$C_6$alkyl), glutamic acid(N—$C_1$-$C_6$alkyl), aspartic acid(N—$C_1$-$C_6$alkyl), glutamine(N—$C_1$-$C_6$alkyl), histidine(N—$C_1$-$C_6$alkyl), lysine(N—$C_1$-$C_6$alkyl), arginine(N—$C_1$-$C_6$alkyl), serine(N—$C_1$-$C_6$alkyl), cysteine(N—$C_1$-$C_6$alkyl), alanine (N-methyl), leucine(N-methyl), methionine(N-methyl), asparagine(N-methyl), glutamic acid(N-methyl), aspartic acid(N-methyl), glutamine(N-methyl), histidine(N-methyl), lysine(N-methyl), arginine(N-methyl), serine(N-methyl), and cysteine(N-methyl).

5. The prodrug of claim 1, wherein for structure (II), $R_4$ is selected from the group consisting of $CH_2$($C_0$-$C_3$ alkyl)($C_3$-$C_6$ cycloalkyl), $CH_2$($C_0$-$C_3$ alkyl)($C_2$-$C_5$ heterocyclic), $CH_2$($C_0$-$C_3$ alkyl)($C_6$-$C_{10}$ aryl)$R_7$, $CH_2$($C_1$-$C_3$ alkyl)($C_3$-$C_9$ heteroaryl), $CH_2$($C_0$-$C_{12}$ alkyl)($W_1$)$C_1$-$C_{12}$ alkyl, wherein $W_1$ is a heteroatom selected from the group consisting of N, S and O, and wherein $R_7$ is selected from the group consisting of H and OH.

6. The prodrug of claim 5 wherein B is selected from the group consisting of phenylalanine(N—$C_1$-$C_{10}$alkyl), tyrosine(N—$C_1$-$C_{10}$alkyl), tryptophan (N—$C_1$-$C_{10}$alkyl), phenylalanine(N—$C_1$-$C_6$alkyl), tyrosine(N—$C_1$-$C_6$alkyl), and tryptophan(N—$C_1$-$C_6$alkyl), phenylalanine(N-methyl), tyrosine(N-methyl), and tryptophan(N-methyl).

7. The prodrug of claim 1, wherein for structure (III), $R_4$ is CH($C_1$-$C_8$ alkyl)$_2$ or CH($C_1$-$C_8$ alkyl)OH.

8. The prodrug of claim 7, wherein B is selected from the group consisting of isoleucine(N—$C_1$-$C_{10}$alkyl), valine(N—$C_1$-$C_{10}$alkyl), threonine(N—$C_1$-$C_{10}$alkyl), isoleucine(N—$C_1$-$C_6$alkyl), valine(N—$C_1$-$C_6$alkyl), threonine(N—$C_1$-$C_6$alkyl), isoleucine(N-methyl), valine(N-methyl), and threonine(N-methyl).

9. The prodrug of claim 1, wherein the aliphatic amino group is the alpha amino group on the N-terminal amino acid of Q or an aliphatic amino group on a side chain of Q.

10. The prodrug of claim 1, wherein for structure (IV), B is selected from the group consisting of glycine(N-methyl), glycine(N-ethyl), glycine(N-propyl), glycine(N-butyl), glycine(N-pentyl), glycine(N-hexyl), glycine(N-heptyl), and glycine(N-octyl).

11. The prodrug of claim 1, wherein for structure (V), $R_4$ is selected from the group consisting of $CH_3$, $CH_2$($C_1$-$C_4$ alkyl), $CH_2(C_1$-$C_4)$ alkenyl, $CH_2(C_0$-$C_4$ alkyl)OH, $CH_2(C_0$-$C_4$ alkyl)SH, $CH_2(C_0$-$C_3$ alkyl)$SCH_3$, $CH_2(C_0$-$C_3$ alkyl)$CONH_2$, $CH_2(C_0$-$C_3$ alkyl)COOH, $CH_2(C_0$-$C_4$ alkyl)$NH_2$, $CH_2(C_0$-$C_3$ alkyl)$NHC(NH_2^+)NH_2$.

12. The prodrug of claim 11, wherein B is selected from the group consisting of alanine(N—$C_1$-$C_{10}$alkyl), leucine(N—$C_1$-$C_{10}$alkyl), methionine(N—$C_1$-$C_{10}$alkyl), asparagine(N—$C_1$-$C_{10}$alkyl), glutamic acid(N—$C_1$-$C_{10}$alkyl), aspartic acid (N—$C_1$-$C_{10}$alkyl), glutamine(N—$C_1$-$C_{10}$alkyl), histidine (N—$C_1$-$C_{10}$alkyl), lysine(N—$C_1$-$C_{10}$alkyl), arginine(N—$C_1$-$C_{10}$alkyl), serine(N—$C_1$-$C_{10}$alkyl), and cysteine(N—$C_1$-$C_{10}$alkyl), -alanine(N—$C_1$-$C_6$alkyl), leucine(N—$C_1$-$C_6$alkyl), methionine(N—$C_1$-$C_6$alkyl), asparagine(N—$C_1$-$C_6$alkyl), glutamic acid(N—$C_1$-$C_6$alkyl), aspartic acid(N—$C_1$-$C_6$alkyl), glutamine(N—$C_1$-$C_6$alkyl), histidine(N—$C_1$-$C_6$alkyl), lysine(N—$C_1$-$C_6$alkyl), arginine(N—$C_1$-$C_6$alkyl), serine(N—$C_1$-$C_6$alkyl), cysteine(N—$C_1$-$C_6$alkyl), alanine (N-methyl), leucine(N-methyl), methionine(N-methyl), asparagine(N-methyl), glutamic acid(N-methyl), aspartic acid(N-methyl), glutamine(N-methyl), histidine(N-methyl), lysine(N-methyl), arginine(N-methyl), serine(N-methyl), and cysteine(N-methyl).

13. The prodrug of 1, wherein for structure (V), $R_4$ is selected from the group consisting of $CH_2(C_0$-$C_3$ alkyl)($C_3$-$C_6$ cycloalkyl), $CH_2(C_0$-$C_3$ alkyl)($C_2$-$C_5$ heterocyclic), $CH_2$ ($C_0$-$C_3$ alkyl)($C_6$-$C_{10}$ aryl)$R_7$, $CH_2(C_1$-$C_3$ alkyl)($C_3$-$C_9$ heteroaryl), and $CH_2(C_0$-$C_{12}$ alkyl)($W_1$)$C_1$-$C_{12}$ alkyl, wherein $W_1$ is a heteroatom selected from the group consisting of N, S and O, and wherein $R_7$ is selected from the group consisting of H and OH.

14. The prodrug of claim 13 wherein B is selected from the group consisting of phenylalanine(N—$C_1$-$C_{10}$alkyl), tyrosine(N—$C_1$-$C_{10}$alkyl), tryptophan(N—$C_1$-$C_{10}$alkyl), phenylalanine(N—$C_1$-$C_6$alkyl), tyrosine(N—$C_1$-$C_6$alkyl), tryptophan(N—$C_1$-$C_6$alkyl)phenylalanine(N-methyl), tyrosine(N-methyl), and tryptophan(N-methyl).

15. The prodrug of claim 1, wherein for structure (VI), $R_4$ is $CH(C_1$-$C_8$ alkyl)$_2$ or $CH(C_1$-$C_8$ alkyl)OH.

16. The prodrug of claim 15, wherein B is selected from the group consisting of isoleucine(N—$C_1$-$C_{10}$alkyl), valine(N—$C_1$-$C_{10}$alkyl), and threonine(N—$C_1$-$C_{10}$alkyl), isoleucine (N—$C_1$-$C_6$alkyl), valine(N—$C_1$-$C_6$alkyl), threonine(N—$C_1$-$C_6$alkyl), isoleucine(N-methyl), valine(N-methyl), and threonine(N-methyl).

17. The prodrug of claim 1, wherein $R_1$ and $R_2$ are independently selected from the group consisting of $C_1$-$C_{10}$ alkyl, $C_2$-$C_{10}$ alkenyl, ($C_1$-$C_{10}$ alkyl)OH, ($C_1$-$C_{10}$ alkyl)SH, ($C_2$-$C_3$ alkyl)$SCH_3$, ($C_1$-$C_4$ alkyl)$CONH_2$, ($C_1$-$C_4$ alkyl)COOH, ($C_1$-$C_4$ alkyl)$NH_2$, ($C_1$-$C_4$ alkyl)$NHC(NH_2^+)NH_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl)$R_7$, ($C_1$-$C_4$ alkyl)($C_3$-$C_9$ heteroaryl), and $C_1$-$C_{12}$ alkyl($W_1$)$C_1$-$C_{12}$ alkyl, wherein $W_1$ is a heteroatom selected from the group consisting of N, S and O, or $R_1$ and $R_2$ together with the atoms to which they are attached form a $C_3$-$C_{12}$ cycloalkyl, and wherein $R_7$ is selected from the group consisting of H and OH.

18. The prodrug of claim 17, wherein A is aminoisobutyric acid.

19. The prodrug of claim 1, wherein $R_1$ is H and $R_2$ is selected from the group consisting of H, $C_1$-$C_{10}$ alkyl, $C_2$-$C_{10}$ alkenyl, ($C_1$-$C_{10}$ alkyl)OH, ($C_1$-$C_{10}$ alkyl)SH, ($C_2$-$C_3$ alkyl) $SCH_3$, ($C_1$-$C_4$ alkyl)$CONH_2$, ($C_1$-$C_4$ alkyl)COOH, ($C_1$-$C_4$ alkyl)$NH_2$, ($C_1$-$C_4$ alkyl)$NHC(NH_2^+)NH_2$, ($C_0$-$C_4$ alkyl)($C_3$-$C_6$ cycloalkyl), ($C_0$-$C_4$ alkyl)($C_2$-$C_5$ heterocyclic), ($C_0$-$C_4$ alkyl)($C_6$-$C_{10}$ aryl)$R_7$, ($C_1$-$C_4$ alkyl)($C_3$-$C_9$ heteroaryl), and $C_1$-$C_{12}$ alkyl($W_1$)$C_1$-$C_{12}$ alkyl, wherein $R_7$ is selected from the group consisting of H and OH, wherein $W_1$ is a heteroatom selected from the group consisting of N, S and O, or $R_1$ and $R_2$ together with the atoms to which they are attached form a $C_3$-$C_{12}$ cycloalkyl, or $R_2$ and $R_5$ together with the atoms to which they are attached form a 4, 5 or 6 member heterocyclic ring.

20. The prodrug of claim 19, wherein A is selected from the group consisting of lysine, cysteine, and alanine.

21. The prodrug of claim 19, wherein A has d-stereochemistry.

22. The prodrug of claim 1, wherein A-B is selected from the group consisting of Aib-Gly(N-Hexyl), dLys-Gly(N-Hexyl), dCys-Gly(N-Hexyl), dAla-Gly(N-Hexyl), Aib-Gly (N-Methyl), dLys-Gly(N-Methyl), dCys-Gly(N-Methyl), dAla-Gly(N-Hexyl), Aib-Phe(N-Methyl), dLys-Phe(N-Methyl), dCys-Phe(N-Methyl), or dAla-Phe(N-Methyl).

23. The prodrug of claim 1 wherein Q is selected from the group consisting of SEQ ID NOs: 1-564, 566-570, 573-575, 577, 579-580, 585-612, 616, 618-632, 634-642, 647, 657-684, 701-732, 742-768, 801-878, 883-919, 1001-1262, 1301-1371, 1401-1518, 1701-1708, 1710, 1711, 1731-1734, 1738, 1740, 1741, 1745, and 1747-1776.

24. The prodrug of claim 1, further comprising a hydrophilic moiety covalently linked to the prodrug.

25. The prodrug of claim 1, further comprising an acyl group or alkyl group covalently linked to the prodrug.

* * * * *

UNITED STATES PATENT AND TRADEMARK OFFICE
CERTIFICATE OF CORRECTION

PATENT NO. : 8,778,872 B2  
APPLICATION NO. : 13/697021  
DATED : July 15, 2014  
INVENTOR(S) : Richard D. DiMarchi and Binbin Kou Page 1 of 1

It is certified that error appears in the above-identified patent and that said Letters Patent is hereby corrected as shown below:

IN THE CLAIMS

In Claim 1, Column 233, Line 48, please delete the phrase "heteroaryl), and $C_{12}$ alkyl($W_1$)$C_1$-$C_{12}$ alkyl, wherein $W_1$" and insert -- heteroaryl), and $C_1$-$C_{12}$ alkyl($W_1$)$C_1$-$C_{12}$ alkyl, wherein $W_1$ -- therefor.

Signed and Sealed this  
Fourteenth Day of April, 2015

Michelle K. Lee  
*Director of the United States Patent and Trademark Office*